United States Patent
Hildinger

(10) Patent No.: US 7,943,374 B2
(45) Date of Patent: May 17, 2011

(54) SUPER-SIZE ADENO-ASSOCIATED VIRAL VECTOR HARBORING A RECOMBINANT GENOME LARGER THAN 5.7 KB

(76) Inventor: Markus Hildinger, Pforzheim (DE)

( * ) Notice: Subject to any disclaimer, the term of this patent is extended or adjusted under 35 U.S.C. 154(b) by 1041 days.

(21) Appl. No.: 11/161,890

(22) Filed: Aug. 21, 2005

(65) Prior Publication Data
US 2007/0042462 A1 Feb. 22, 2007

(51) Int. Cl.
C12N 15/63 (2006.01)
C12N 15/85 (2006.01)

(52) U.S. Cl. ................................ 435/320.1; 435/325

(58) Field of Classification Search .................. None
See application file for complete search history.

(56) References Cited

U.S. PATENT DOCUMENTS

| | | | |
|---|---|---|---|
| 4,797,368 A | 1/1989 | Carter et al. | |
| 5,139,941 A | 8/1992 | Muzyczka et al. | |
| 5,219,740 A | 6/1993 | Miller et al. | |
| 5,658,785 A | 8/1997 | Johnson | |
| 5,677,158 A * | 10/1997 | Zhou et al. | 435/457 |
| 5,854,019 A | 12/1998 | Sedlacek et al. | |
| 5,866,552 A | 2/1999 | Wilson et al. | |
| 6,001,650 A | 12/1999 | Colosi | |
| 6,004,797 A | 12/1999 | Colosi et al. | |
| 6,027,931 A | 2/2000 | Natsoulis et al. | |
| 6,346,415 B1 | 2/2002 | Feldhaus | |
| 6,531,456 B1 | 3/2003 | Kurtzman et al. | |
| 6,723,551 B2 | 4/2004 | Kotin et al. | |
| 6,797,505 B2 | 9/2004 | Snyder et al. | |
| 2002/0131956 A1 | 9/2002 | Walsh et al. | |
| 2004/0029106 A1 | 2/2004 | Samulski et al. | |
| 2004/0052764 A1 | 3/2004 | Hildinger | |

* cited by examiner

*Primary Examiner* — Michele K Joike
(74) *Attorney, Agent, or Firm* — Markus Hildinger

(57) ABSTRACT

Prior art teaches an effective packaging capacity for adeno-associated virus and adeno-associated viral vectors of 4.1 kb to 4.9 kb as well as a packaging limit of 5.2 kb to 5.6 kb. However, the inventor discovered that this packaging limit as well as that effective packaging capacity does not apply to all AAV serotypes: Whereas it is true that efficient packaging of AAV serotype 2 is limited to less than 5 kb, the inventor discovered that one can efficiently package more than 6 kb of genetic information into AAV capsids of other AAV serotypes, particularly into capsids of AAV serotype 5 and—to a lesser extent—into capsids of AAV serotype 7. This discovery will be useful in the context of gene therapy where large transgenes will have to be transferred such as the ABCA4 coding sequence, the Factor VIII coding sequence, the B-deleted Factor VIII coding sequence or minidystrophin genes.

27 Claims, No Drawings

SUPER-SIZE ADENO-ASSOCIATED VIRAL VECTOR HARBORING A RECOMBINANT GENOME LARGER THAN 5.7 KB

INCORPORATION-BY-REFERENCE OF MATERIAL SUBMITTED ON A COMPACT DISC

A paper copy of the Sequence Listing and a computer readable form (CRF) of the sequence listing, containing the file named sequences.ST25.txt which is 815 kilobytes in size, and which was created on Aug. 6, 2005 and last modified on Aug. 22, 2005, are herein incorporated by reference. The symbols and format used for nucleotide and amino acid sequence data comply with the rules set forth in 37 C.F.R. section.

BACKGROUND OF THE INVENTION

It must be noted that as used herein and in the appended claims, the singular forms "a" and "the" include plural referents unless the context clearly dictates otherwise. Thus, for example, reference to "a cell" or "the cell" includes a plurality ("cells" or "the cells"), and so forth. Moreover, the word "or" can either be exclusive in nature (i.e., either A or B, but not A and B together), or inclusive in nature (A or B, including A alone, B alone, but also A and B together). One of skill in the art will realize which interpretation is the most appropriate unless it is detailed by reference in the text as "either A or B" (exclusive "or") or "and/or" (inclusive "or").

The inventor can be contacted at hildinger@gmx.net.

A portion of the disclosure of this patent document contains material which is subject to copyright protection. The copyright owner has no objection to the facsimile reproduction by anyone of the patent document or the patent disclosure as it appears in the Patent and Trademark Office file or records, but otherwise reserves all copyright rights whatsoever.

(1) Field of the Invention

This invention relates to AAV-mediated gene transfer in general and to AAV-mediated transfer of (recombinant) AAV genomes larger than 5.7 kb, 6 kb, 6.5 kb, 7 kb, 7.5 kb, 7.8 kb or 8 kb in particular. In that respect, the present invention will find use in gene therapy in general, and particularly in gene therapy applications where large recombinant genomes will have to be transferred. In preferred embodiments, the AAV vectors of the present invention will comprise recombinant AAV genomes, where said recombinant AAV genomes comprise transgene expression cassettes larger than 6 kb, 6.5 kb, 7 kb or 7.5 kb, and where said transgene expression cassettes comprise a nucleotide sequence encoding the ABCR protein (as referenced in SEQ ID NO: 2), the Factor VIII protein (as referenced in SEQ ID NO: 4), a B-deleted Factor VIII protein (as referenced in SEQ ID NO: 6) or a minidystrophin protein (as referenced in SEQ ID NO: 8).

The size of the recombinant AAV genome of the present invention depends on the application. Examples for the need to transfer recombinant AAV genomes larger than 5.7 kb are:

The transfer of coding sequences close to or larger than 5.7 kb such as the full-length ABCA4 coding sequence (as referenced in SEQ ID NO: 1), the Factor VIII coding sequence (as referenced in SEQ ID NO: 3), or a minidystrophin coding sequence (as referenced in SEQ ID NO: 7).

Further examples are long coding sequences which—in combination with regulatory elements and indispensable AAV cis elements—exceed at least 5.7 kb or can exceed at least 5.7 kb, such as the CFTR coding sequence (as referenced in SEQ ID NO: 32), the B-deleted Factor VIII coding sequence (as referenced in SEQ ID NO: 5), the Usherin-2a coding sequence (as referenced by SEQ ID NO: 34).

Other examples are self-complementary AAV vectors where the transgene expression cassette including AAV cis elements exceeds at least 2.85 kb, at least 3 kb, at least 3.25 kb, at least 3.5 kb, at least 3.75 kb or at least 3.9 kb, or at least 4.0 kb, such as self-complementary AAV vectors harboring the PDE 6b coding sequence (referenced by SEQ ID NO: 58) in combination with regulatory sequences and/or AAV cis elements, where said regulatory sequences and/or AAV cis elements exceed 300 nucleotides.

Thus, the present invention will find use in medical applications in the context of gene therapy to treat diseases such as Stargardt Disease, by transducing affected cells with an AAV vector harboring an ABCA4 expression cassette;

Hemophilia A, by transducing mammalian cells with an AAV vector harboring a Factor VIII expression cassette, or by transducing mammalian cells with an AAV vector harboring a B-deleted Factor VIII expression cassette;

Duchenne Muscular Dystrophy (DMD), by transducing affected cells with an AAV vector harboring a minidystrophin expression cassette;

Cystic fibrosis (CF), by transducing affected cells with an AAV vector of the present invention harboring a CFTR expression cassette as well as additional elements, where those additional elements exceed ~1.3 kb.

Those diseases are caused by mutations in genes whose coding sequence exceed (apart from Cystic Fibrosis) 5.5 kb, which—according to prior art—would exceed in combination with regulatory elements and AAV cis elements the effective packaging capacity of AAV vectors. Yet, the present invention is not limited to the treatment of the diseases listed above, but generally appicable to the AAV-mediated transfer of recombinant AAV genomes larger than 5.7 kb, 6 kb, 6.5 kb, 7 kb, 7.5 kb, 7.8 kb or 8 kb. For example, the AAV-mediated transfer of a 3 kb coding sequence in combination with a 3 kb promoter sequence as part of a transgene expression cassette would still fall within the scope of the present invention.

(2) Description of Related Art

The inventor would like to call particular attention to section (b) of "Description of Related Art", where the effective AAV packaging capacity as well as the AAV packaging limit are discussed.

(a) Adeno-Associated Viral Vectors

Adeno-associated virus (AAV) is a small non-pathogenic virus of the parvoviridae family. AAV is distinct from the other members of this family by its dependence on a helper virus for replication. The approximately 4.7 kb genome of AAV consists of single stranded DNA of either plus or minus polarity. The ends of the genome are short inverted terminal repeats (ITRs) which can fold into hairpin structures and serve as the origin of viral DNA replication. Physically, the parvovirus virion is non-enveloped and its icosohedral capsid is approximately 20 nm in diameter. To date, at least 11 serologically distinct AAVs have been identified and isolated from humans or primates and are referred to as AAV serotypes 1-11.

The genome of AAV2 is 4,680 nucleotides in length and contains two open reading frames (ORFs): The left ORF encodes the non-structural Rep proteins, Rep40, Rep52, Rep68 and Rep78, which are involved in regulation of replication and transcription in addition to the production of single-stranded progeny genomes. Furthermore, two of the Rep proteins have been associated with the preferential integration of AAV2 genomes into a region of the q arm of human chromosome 19. Rep68/78 have also been shown to possess NTP binding activity as well as DNA and RNA helicase activities. The Rep proteins possess a nuclear localization signal as well as several potential phosphorylation sites. Mutation of one of these kinase sites resulted in a loss of replication activity. The ends of the genome are short inverted terminal repeats which have the potential to fold into T-shaped hairpin structures that serve as the origin of viral DNA replication. Within the ITR region two elements have been described which are central to the function of the ITR, a GAGC repeat motif and the terminal resolution site (trs). The repeat motif has been shown to bind Rep when the ITR is in either a linear or hairpin conformation. This binding serves to position Rep68/78 for cleavage at the trs which occurs in a site- and strand-specific manner. In addition to their role in replication, these two elements appear to be central to viral integration. Contained within the chromosome 19 integration locus is a Rep binding site with an adjacent trs. These elements have been shown to be functional and necessary for locus specific integration.

The right ORF of AAV2 encodes related capsid proteins referred to as VP1, 2 and 3. These capsid proteins form the icosahedral, non-enveloped virion particle of ~20 nm diameter. VP1, 2 and 3 are found in a ratio of 1:1:10. The capsid proteins differ from each other by the use of alternative splicing and an unusual start codon. Deletion analysis has shown that removal or alteration of VP1, which is translated from an alternatively spliced message, results in a reduced yield of infectious particles. Mutations within the VP3 coding region result in the failure to produce any single-stranded progeny DNA or infectious particles.

The findings described in the context of AAV2 are generally applicable to other AAV serotypes as well.

The following features of AAV have made it an attractive vector for gene transfer: AAV vectors possess a broad host range, transduce both dividing and non dividing cells in vitro and in vivo and maintain high levels of expression of the transduced genes in the absence of a significant immune response to the transgene product in general. Moreover, as wild-type AAV is non-pathogenic, AAV vector particles are assumed to be non-pathogenic as well (in contrast to adenoviral vectors). Viral particles are heat stable, resistant to solvents, detergents, changes in pH and temperature. The ITRs have been shown to be the only cis elements required for replication and packaging and may contain some promoter activities. Thus, no viral genes are encoded by AAV vectors.

Vectors based on adeno-associated virus (AAV) emerged as those preferred for achieving truly stable transduction following in vivo administration. The recent isolation and characterization of several new AAV serotypes provides new opportunities for vector development. For example, Chiorini and colleagues created replication defective versions of AAV serotype 5 (AAV5) for gene transfer. Transduction efficiency was substantially improved with AAV5-based vectors when compared with those based on AAV2 in several applications, including those involving muscle and lung. Another improvement in the art was the creation of hybrid vectors based on AAV2 inverted terminal repeats (ITRs) produced with AAV2 rep and AAV5 cap. The resulting defective vector packages an AAV2 genome in an AAV5 capsid. The transduction efficiency of the AAV2/5 hybrid is superior to that of AAV2 in lung, muscle, and retina. A further advantage of AAV vectors based on serotype 5 capsids is that humans do not harbor antibodies capable of interfering with AAV5 transduction. There is also clinical experience using AAV vectors to safely transfer genes to human organs.

To summarize: AAV is a small non-enveloped icosahedral parvovirus with a 4.7-kb single-stranded DNA genome. AAV is a naturally replication-defective virus that depends on adenovirus (Ad) or herpes simplex virus gene products for replication. The absence of any detectable pathology from wild-type AAV infections coupled with its ability to remain latent promoted its development as a gene transfer vector. Recombinant vectors based on AAV are effective in long-term gene transfer to skeletal and cardiac muscle, liver, brain, and retina in the absence of an immune response even to non-self transgene products.

AAV vectors are designed in a fashion such that all viral genes are replaced by an expression cassette for the transgene, leaving intact the essential cis elements of the genome, the inverted terminal repeats (ITRs), DNA packaging signal, and the replication origin (Backlow, 1988). Replication and packaging of AAV vectors requires all AAV and Ad/ HSV helper functions to be provided in trans. Whereas wild-type AAV is capable of integrating in a site-specific manner into human chromosome 19, site-specific integration of recombinant AAV does not seem to occur to a significant extent (due to the lack of Rep Protein expression in AAV vectors). Moreover, the onset of gene expression is generally delayed by 2-4 weeks.

(b) Effective Packaging Capacity of AAV Virions

The inventor considers the following publications as essential prior art:

[A]: Dong et al.: "Quantitative analysis of the packaging capacity of recombinant adeno-associated virus." in Hum Gene Ther. Nov. 10, 1996;7(17):2101-12.

[B]: Hermonat et al.: "The packaging capacity of adeno-associated virus (AAV) and the potential for wild-type-plus AAV gene therapy vector" in FEBS Lett. Apr. 21, 1997;407(1):78-84.

[C]: Ostedgaard et al.: "A shortened adeno-associated virus expression cassette for CFTR gene transfer to cystic fibrosis airway epithelia." in Proc Natl Acad Sci USA. Feb. 22, 2005; 102(8):2952-7.

[D]: Flotte et al.: "Expression of the cystic fibrosis transmembrane conductance regulator from a novel adeno-associated virus promoter."J Biol Chem. Feb. 15, 1993; 268(5):3781-90.

[E]: Zhang et al.: "Efficient expression of CFTR function with adeno-associated virus vectors that carry shortened CFTR genes." Proc Natl Acad Sci USA. Aug. 18, 1998; 95(17):10158-63.

The 1996 publication of Dong et al. [A] teaches an effective packaging capacity for AAV vectors of 4.1 to 4.9 kb and a packaging limit of 5.2 kb. I quote: "Our studies showed that the optimal size of AAV vector is between 4.1 and 4.9 kb. Although AAV can package a vector larger than its genome size, up to 5.2 kb, the packaging efficiencies in this large size range were sharply reduced."

Similarly, the 1997 publication of Hermonat et al. [B] teaches an effective packaging capacity for AAV up to 119% of wild-type, or 5.6 kb. I quote: "These data indicate that the maximum effective packaging capacity of AAV is approximately 900 bp larger than wild type, or 119% . . . These data suggest that therapy vectors carrying a foreign gene of 900 bp or less can be generated from AAV."

Another prior art publication of February 2005 by Ostedgaard et al. [C] states: "The 6,065-bp total length exceeds the packaging capacity of AAV (refs. 14-16 and unpublished observations). Substituting the recently developed shortened CFTR transgene, CFTRΔR (4,287 bp) (24), reduced the cassette length to 5,902 bp. However, this still exceeds the packing limits." This publication further claims: "A limitation of AAV vectors is the relatively small AAV genome. Studies testing the insert size suggest that 4,100-4,900 bp is the optimal genome size for packaging (14). Other studies and our own unpublished data also suggest that packaging becomes very inefficient whenever insert sizes exceed 4,900-5,000 bp (15, 16). This poses a problem for genes with large coding sequences . . . " The authors of that publication constructed then a vector smaller than 5 kb in size.

Contrary to those prior-art publications, the inventor discovered that the effective packaging capacity of AAV is larger than 5.7 kb, larger than 6 kb, larger than 6.5 kb, larger than 7 kb, larger than 7.5 kb, larger than 7.8 kb and larger than 8 kb. Moreover, the inventor discovered that the AAV packaging limit is larger than 5.7 kb, larger than 6 kb, larger than 6.5 kb, larger than 7 kb, larger than 7.5 kb, larger than 7.8 kb and larger than 8 kb. In detail, the inventor discovered that the effective packaging capacity and the packaging limit vary as a function of serotype: Whereas the effective packaging capacity and packaging limit for AAV2 is in the range of published prior art data, this is not true for other serotypes such as recombinant AAV vectors comprising an AAV5 capsid or an AAV7 capsid. The capsid of AAV5 and the capsid of AAV7 seem to be able to accommodate larger genomes. Particularly AAV5 packages large genomes even beyond 6.5 kb and up to 8 kb with high efficacy.

(c) Stargardt Disease

Stargardt disease, also known as fundus flavimaculatus, is the most common form of inherited juvenile macular degeneration. It is characterized by a reduction of central vision with a preservation of peripheral (side) vision. Stargardt disease is usually diagnosed in individuals under the age of 20 when decreased central vision is first noticed. On examination, the retina of an affected individual shows a macular lesion surrounded by yellow-white flecks, or spots, with irregular shapes. The retina consists of layers of light-sensing cells that line the inner back wall of the eye and are important in normal vision. The macula is found in the center of the retina and is responsible for the fine, detailed central vision used in reading and color vision.

The progression of visual loss is variable. One study of 95 individuals with Stargardt disease showed that once a visual acuity of 20/40 was reached, there was often rapid progression of additional visual loss until acuity was reduced to 20/200 (legal blindness). By age 50, approximately 50 percent of all those studied had visual acuities of 20/200 or worse. Eventually, almost all individuals with Stargardt disease are expected to have visual acuities in the range of 20/200 to 20/400. The reduced visual acuity due to Stargardt disease cannot be corrected with prescription eyeglasses or contact lenses. In late stages of the disease, there may also be noticeable impairment of color vision.

Stargardt disease is almost always inherited as an autosomal recessive disorder. It is inherited when both parents, called carriers, have one gene for the disease paired with one normal gene. Carriers are unaffected because they have only one copy of the gene. The gene responsible for Stargardt disease has been identified as the ABCA4 gene, which encodes the ABCR protein (referenced by SEQ ID NO: 2). ABCR stands for "ATP-binding cassette transporter—retinal".

The ABCR protein plays an important role in the visual cycle: All-trans retinal, which is released into the disc lumen of the photoreceptor cells, reacts with phosphatidyl ethanolamine (PE) to N-retinylidene-PE, which is subsequently transported into the cytosol by the function of the ABCR. Thus, ABCR is the rate keeper of retinal transport in the visual cycle. If ABCR function is lost, N-retinylidene-PE accumulates in the disc lumen. Once the discs are phagocytosed by Retinal Pigment Epithelium (RPE) cells, excessive N-retinylidene-PE is transformed into N-retinylidine-N-retinylethanolamine (A2-E), which is a major component of lipofuscin. Accumulation of lipofuscin leads to RPE cell apoptosis. Thus, mutations in the ABCR gene produce a dysfunctional protein that cannot perform its transport function. As a result, photoreceptor cells degenerate and vision loss occurs. The most common mutations, accounting for 10% of all cases of autosomal recessive Stargardt Disease, are G1961E, G863A, ΔG863, and A1038V.

(d) Hemophilia A

Hemophilia A is a hereditary blood coagulation (clotting) disorder. It is caused by a deficient activity of plasma protein factor VIII (referenced by SEQ ID NO: 4), which affects the clotting property of blood. Hemophilia A is the most common of blood coagulation disorder. The disorder is caused by an inherited X-linked recessive trait, with the defective gene located on the X chromosome. Thus, the disorder occurs primarily in males. Females carry two copies of the X chromosome, so if the factor VIII gene on one chromosome is defective, the gene on the other chromosome can compensate. Males, however, carry only one X chromosome, so if the factor VIII gene on that chromosome is defective, they will have the disease.

The human Factor VIII cDNA (FVIII cDNA) has been cloned. FVIII is synthesized as a 2351 amino acid residue, single chain precursor composed of a 19 amino acid signal peptide and six distinct domains. The domains are arranged in the order, A1-A2-B-A3-C1-C2. An A domain contains about 330 amino acids and is present in three copies. A C domain contains about 150 amino acids and is present in two copies. The B domain contains about 909 amino acids and is extremely rich in potential N-linked glycosylation sites. The translation product of the FVIII gene first is cleaved between the B domain and the A3 domain. Then, the B domain is proteolysed at multiple sites leaving FVIII as a divalent metal ion-linked complex consisting of the heavy chain (H chain) of 90-200 kDa and the light chain (L chain) of 80 kDa. The minimal functional unit of FVIII is the heterodimer consisting of the 90 kDa H chain and the 80 kDa L chain. Thus, the B domain is dispensable for procoagulant activity. Circulating FVIII in blood is associated with the von Willebrand factor (vWF) which is a large multimeric, multifunctional product. Expression of full-length FVIII cDNA in mammalian cells was reported by several groups, but the levels of expression were very low and insufficient for economical production of recombinant FVIII (rFVIII). To improve expression efficiency, modified FVIII cDNA's lacking most of the B domain were made and the resulting products were shown to retain functional activities of FVIII.

The severity of symptoms can vary with this disease, and the severe forms become apparent early on. Bleeding is the hallmark of the disease and sometimes, though not always, occurs if an infant is circumcised. Additional bleeding manifestations make their appearance when the infant becomes mobile.

Mild cases may go unnoticed until later in life when they occur in response to surgery or trauma. Internal bleeding may happen anywhere, and bleeding into joints is common. Risk factors are a family history of bleeding and being male. Hemophilia A occurs in about 1 out of 5,000 men. Symptoms are bruising, spontaneous bleeding, bleeding into joints and associated pain and swelling, gastrointestinal tract and urinary tract hemorrhage, blood in the urine or stool, prolonged bleeding from cuts, tooth extraction, and surgery.

Many blood clotting tests are performed if the person tested is the first one in the family to have a bleeding disorder. Once the defect has been identified, other family members will need less testing to diagnose the disorder. Tests include prolonged PTT, normal prothrombin time, normal bleeding time, normal fibrinogen level, low serum factor VIII activity.

Standard treatment is infusion of factor VIII concentrates to replace the defective clotting factor. The amount infused depends upon the severity of bleeding, the site of the bleeding, and the size of the patient. Mild hemophilia may be treated with infusion of cryoprecipitate or desmopressin (DDAVP), which causes release of factor VIII that is stored within the body on the lining of blood vessels. To prevent a bleeding crisis, people with hemophilia and their families can be taught to administer factor VIII concentrates at home at the first signs of bleeding. People with severe forms of the disease may need regular prophylactic infusions. Depending on the severity of the disease, DDAVP or factor VIII concentrate may be given prior to dental extractions and surgery to prevent bleeding.

With treatment, the outcome is good. Most people with hemophilia are able to lead relatively normal lives. A small percentage of people with hemophilia will develop inhibitors of factor VIII, and may die from loss of blood.

Complications include chronic joint deformities, caused by recurrent bleeding into the joint, and should be managed by an orthopedic specialist. These problems sometimes require joint replacement. Recurrent transfusions may increase the risk of contracting HIV and hepatitis, especially prior to 1985 when blood screening procedures were improved for detecting the HIV virus. However, new heat processing treatment makes factor VIII material free of the HIV virus and thus safe for use. Intracerebral hemorrhage is another possible complication (see deep intracerebral hemorrhage, lobar intracerebral hemorrhage).

(e) Duchenne Muscular Dystrophy

Duchenne muscular dystrophy is an inherited disorder characterized by rapidly progressive muscle weakness which starts in the legs and pelvis and later affects the whole body. It is caused by a defective gene, the dystrophin gene, but it often occurs in people from families without a known family history of the condition. It is marked by progressive loss of muscle function, which begins in the lower limbs. The cause of the muscle impairment is an abnormal gene for dystrophin (a protein in the muscles).

Duchenne muscular dystrophy is inherited in an X-linked recessive pattern. Because women have two X chromosomes, if one contains a normal copy of the gene, that gene will make enough of the protein to prevent symptoms. But boys have an X chromosome from their mother and a Y from father, so if the X chromosome is defective, there is no second X to make up for it and they will develop the disease.

Symptoms usually appear before age 6 and may appear as early as infancy. There is progressive muscle weakness of the legs and pelvis, which is associated with a loss of muscle mass (wasting). Muscle weakness also occurs in the arms, neck, and other areas, but not as severely or as early as in the lower half of the body. Calf muscles initially enlarge—the enlarged muscle tissue is eventually replaced by fat and connective tissue (pseudohypertrophy). Muscle contractures occur in the legs, rendering the muscles unusable because the muscle fibers shorten and fibrosis occurs in connective tissue.

Symptoms usually appear in boys aged 1-6. By age 10, braces may be required for walking, and by age 12, most patients are confined to a wheelchair. Bones develop abnormally, causing skeletal deformities of the spine and other areas. Muscular weakness and skeletal deformities contribute to frequent breathing disorders. Cardiomyopathy occurs in almost all cases. Intellectual impairment may occur, but it is not inevitable and does not worsen as the disorder progresses.

Duchenne muscular dystrophy occurs in approximately 2 out of 10,000 people. Because this is an inherited disorder, risks include a family history of Duchenne muscular dystrophy. In contrast, Becker muscular dystrophy is a form that progresses much more slowly.

Symptoms include muscle weakness, rapidly progressive, frequent falls, difficulty with motor skills (running, hopping, jumping), progressive difficulty walking, ability to walk may be lost by age 12, fatigue, intellectual retardation (possible), skeletal deformities, chest and back (scoliosis), muscle deformities, contractures of heels and legs, pseudohypertrophy of calf muscles. Muscle wasting (atrophy) begins in the legs and pelvis, then progresses to the muscles of the shoulders and neck, followed by loss of arm muscles and respiratory muscles. Calf muscle enlargement (pseudohypertrophy) is quite obvious.

Cardiomyopathy is commonly present, but signs of congestive heart failure or arrhythmias (irregular heartbeats) are rare. Respiratory disorders are common during the later stages, including pneumonia and aspiration of food or fluid into the lungs.

As far as diagnosis is concerned, a serum CPK is highly elevated. A neurologic exam demonstrates weaness and lack of coordination or balance. An EMG (electromyography) shows that weakness is caused by destruction of muscle tissue rather than nerve damage. A muscle biopsy confirms the diagnosis.

There is no known cure for Duchenne muscular dystrophy. Treatment is aimed at control of symptoms to maximize the quality of life. Gene therapy may become available in the future. Activity is encouraged. Inactivity (such as bedrest) can worsen the muscle disease. Physical therapy may be helpful to maintain muscle strength and function. Orthopedic appliances (such as braces and wheelchairs) may improve mobility and the ability for self-care. The stress of illness can often be helped by joining a support group where members share common experiences and problems. See muscular dystrophy—support group. The Muscular Dystrophy Association is an excellent source of information on this disease.

Duchenne muscular dystrophy results in rapidly progressive disability. Death usually occurs by age 25, typically from respiratory (lung) disorders. Complications include deformities, permanent, progressive disability, decreased mobility, decreased ability for self-care, mental impairment (varies, usually minimal), pneumonia or other respiratory infections, respiratory failure, cardiomyopathy, congestive heart failure (rare), heart arrhythmias (rare).

BRIEF SUMMARY OF THE INVENTION (1) Substance or General Idea of the Claimed Invention The present invention relates generally to DNA delivery methods. More particularly, the invention relates to the use of recombinant adeno-associated virus (AAV) virions for in vitro or in vivo delivery of (recombinant) AAV genomes larger than 5.7 kb, 6 kb, 6.5 kb, 7 kb, 7.5 kb, 7.8 kb, or 8 kb in particular. The invention also relates to methods of transducing mammalian cells with the recombinant AAV virions of the present invention.

In another asepct, the present invention relates to the effective packaging capacity of AAV virions: The present invention teaches an effective packaging capacity of AAV vectors larger than 5.7 kb, 6 kb, 6.5 kb, 7 kb, 7.5 kb, 7.8 kb or 8 kb. This applies in particular to AAV vectors with capsids derived from AAV serotype 5 or AAV serotype 7.

In yet another aspect, the present invention relates to the packaging limit of AAV virions: The present invention teaches a packaging limit of AAV vectors larger than 5.7 kb, 6 kb, 6.5 kb, 7 kb, 7.5 kb, 7.8 kb or 8 kb. This applies in particular to AAV vectors with capsids derived from AAV serotype 5 or AAV serotype 7.

The method described in the present invention provides for expression of coding sequences such as the ABCA4 coding sequence, the Factor VIII coding sequence, and minidystrophin coding sequences which—according to prior art—would exceed the effective packaging capacity of AAV vectors. This method is particularly useful for patients suffering from Stargardt Disease, Hemophilia A, or Duchenne Muscular Dystrophy.

The recombinant AAV virions of the present invention comprise recombinant AAV vector genomes, where said rAAV vector genomes have a length of at least 5.7 kb, at least 6 kb, at least 6.5 kb, at least 7 kb, at least 7.5 kb, at least 7.8 kb, or at least 8 kb.

(2) Advantages of the Invention Over Prior Approaches

The present invention is useful, novel, and not obvious.

Usefulness of the Present Invention

The present invention will prove useful in the context of gene therapy in general, and AAV-mediated gene transfer in particular, where a transgene expression cassette will have to be transferred whose size is at least 5.7 kb, at least 6 kb, at least 6.5 kb, at least 7 kb, at least 7.5 kb, at least 7.8 kb or at least 8 kb. A transgene expression cassette of said size is required in several contexts:

If the coding sequence of the gene to be transferred exceeds a certain length, e.g., the ABCA4 coding sequence (6,822 nucleotides; referenced by SEQ ID NO: 1), a minidystrophin coding sequence (5,592 nucleotides; referenced by SEQ ID NO: 8), the Factor VIII coding sequence (7,056 nucleotides, referenced by SEQ ID NO: 3). All of those coding sequences would exceed the effective packaging capacity of AAV vectors as described in prior art.

If the combination of coding sequence and regulatory elements exceeds a certain length, e.g., the CFTR coding sequence (4,443 kb, referenced by SEQ ID NO: 32) in combination with regulatory and AAV cis elements, where said elements exceed 1,300 nucleotides, or the usherin-2a coding sequence (4,641 kb, referenced by SEQ ID NO: 34) in combination with regulatory and AAV cis elements, where said elements exceed 1,100 nucleotides, or a B-deleted Factor VIII coding sequence (4,428 kb, referenced by SEQ ID NO: 5) in combination with regulatory and AAV cis elements, where said elements exceed 1,300 nucleotides.

If self-complementary AAV vectors should be produced where the transgene expression cassette including AAV cis elements exceeds at least 2.85 kb, at least 3 kb, at least 3.25 kb, at least 3.5 kb, at least 3.75 kb or at least 3.9 kb, or at least 4.0 kb.

Thus, the present invention will find use in medical applications in the context of gene therapy to treat diseases such as Stargardt Disease, by transducing affected cells with an AAV vector harboring an ABCA4 expression cassette;

Hemophilia A, by transducing mammalian cells with an AAV vector harboring a Factor VIII expression cassette, or by transducing mammalian cells with an AAV vector harboring a B-deleted Factor VIII expression cassette;

Duchenne Muscular Dystrophy (DMD), by transducing affected cells with an AAV vector harboring a minidystrophin expression cassette;

Cystic fibrosis (CF), by transducing affected cells with an AAV vector of the present invention harboring a CFTR coding sequence as well as additional elements, where those additional elements exceed ~1.3 kb;

Certain forms of Usher disease, where the disease is caused by mutations in the Usherin-2a gene;

Diseases where self-complementary AAV vectors are to be used in order to guarantee a fast onset of gene expression, e.g., Retinitis Pigmentosa caused by mutations in the phosphodiesterase 6b subunit gene (referenced by SEQ ID NO: 58).

Novelty of the Present Invention

The present invention is also novel in that respect as there are no prior art references describing an AAV vector harboring a (recombinant) AAV genome whose size is at least 5.7 kb, at least 6 kb, at least 6.5 kb, at least 7 kb, at least 7.5 kb, at least 7.8 kb, or at least 8 kb.

Furthermore, prior art describes the effective packaging capacity of AAV vectors in the range of 4.1 to 4.9 kb [A], whereas the present invention teaches an effective packaging capacity of at least 5.7 kb, at least 6 kb, at least 6.5 kb, at least 7 kb, at least 7.5 kb, at least 7.8 kb or at least 8 kb—particularly in the context of AAV serotype 5 and AAV serotype 7.

Moreover, prior art describes the packaging limit of AAV vectors as 5.6 kb [B], whereas the present invention teaches a packaging limit of at least 5.7 kb, at least 6 kb, at least 6.5 kb, at least 7 kb, at least 7.5 kb, at least 7.8 kb, or at least 8 kb—particularly in the context of AAV serotype 5 and AAV serotype 7.

The effective packaging capacity as well as the packaging limit in the prior art was determined based on observations with AAV serotype 2. The inventor was able to confirm those observations for AAV serotype 2, but discovered that other AAV serotypes—particularly AAV serotype 5 and AAV serotype 7—have a higher effective packaging capacity and a higher packaging limit compared to AAV serotype 2. Thus, one can package per se as well as efficiently package recombinant genomes of at least 5.7 kb, at least 6 kb, at least 6.5 kb, at least 7 kb, at least 7.5 kb, at least 7.8 kb or at least 8 kb into capsids of AAV serotype 5, even if those recombinant genomes harbor ITR sequences that are not derived from AAV serotype 5.

The 1996 publication of Dong et al. [A] teaches an effective packaging capacity for AAV vectors of 4.1 to 4.9 kb and a packaging limit of 5.2 kb. I quote: "Our studies showed that the optimal size of AAV vector is between 4.1 and 4.9 kb. Although AAV can package a vector larger than its genome size, up to 5.2 kb, the packaging efficiencies in this large size range were sharply reduced."

Similarly, the 1997 publication of Hermonat et al. [B] teaches an effective packaging capacity for AAV up to 119% of wild-type, or 5.6 kb. I quote: "These data indicate that the maximum effective packaging capacity of AAV is approximately 900 bp larger than wild type, or 119% . . . These data suggest that therapy vectors carrying a foreign gene of 900 bp or less can be generated from AAV."

Another prior art publication of February 2005 by Ostedgaard et al. [C] states: "The 6,065-bp total length exceeds the packaging capacity of AAV (refs. 14-16 and unpublished observations). Substituting the recently developed shortened CFTR transgene, CFTRΔR (4,287 bp) (24), reduced the cassette length to 5,902 bp. However, this still exceeds the packing limits." This publication further claims: "A limitation of AAV vectors is the relatively small AAV genome. Studies testing the insert size suggest that 4,100-4,900 bp is the optimal genome size for packaging (14). Other studies and our own unpublished data also suggest that packaging becomes very inefficient whenever insert sizes exceed 4,900-5,000 bp (15, 16). This poses a problem for genes with large coding sequences The authors of that publication constructed then a vector smaller than 5 kb in size.

Contrary to those prior-art publications, the inventor discovered that the effective packaging capacity of AAV is larger than 5.7 kb, larger than 6 kb, larger than 6.5 kb, larger than 7 kb, larger than 7.5 kb, larger than 7.8 kb and larger than 8 kb. Moreover, the inventor discovered that the AAV packaging limit is larger than 5.7 kb, larger than 6 kb, larger than 6.5 kb, larger than 7 kb, larger than 7.5 kb, larger than 7.8 kb and larger than 8 kb. In detail, the inventor discovered that the effective packaging capacity and the packaging limit vary as a function of serotype: Whereas the effective packaging capacity and packaging limit for AAV2 is in the range of published prior art data, this is not true for other serotypes such as recombinant AAV vectors comprising an AAV5 capsid or an AAV7 capsid. The capsid of AAV5 and the capsid of AAV7 seem to be able to accommodate larger genomes. Particularly AAV5 packages large genomes even beyond 6.5 kb and up to 8 kb with high efficacy.

Non-Obviousness of the Present Invention

The present invention is also not obvious due to the following reasons:

Prior art teaches an effective packaging capacity of 4.1 to 4.9 kb [A] for AAV vectors as well as a packaging limit of 5.6 kb [B]. Those experiments were performed with AAV serotype 2, and the artisan of ordinary skill in the art assumed those observations to be true also for all other AAV serotypes. However, according to the discovery of the inventor as disclosed in the present invention, this does not apply, and there are differences between the different AAV serotypes.

If it were obvious to the artisan that there was no general effective packaging capacity and packaging limit for AAV vectors independent of the AAV serotype, artisans would not spend additional efforts to decrease the size of recombinant AAV genomes to make them smaller than 5 kb in size such as described in the publication of Ostedgaard [C], especially if the artisans use AAV5 capsids for genome encapsidation as in that case.

Furthermore, if it were obvious to the artisan that one can efficiently package at least 5.7 kb, at least 6 kb, at least 6.5 kb, at least 7 kb, at least 7.5 kb, at least 7.8 kb or at least 8 kb into AAV capsids, scientists would not have worked on alternative strategies to enable expression of "large" transgenes using AAV vectors. Those strategies include trans-splicing AAV vectors (Xu et al.: "Trans-splicing adeno-associated viral vector-mediated gene therapy is limited by the accumulation of spliced mRNA but not by dual vector coinfection efficiency."; Hum Gene Ther. September 2004;15(9):896-905), recombining AAV vectors (Halbert et al.: "Efficient mouse airway transduction following recombination between AAV vectors carrying parts of a larger gene."; Nat Biotechnol. July 2002; 20(7):697-701), or strategies, where a protein is divided into two separate parts (Ahn et al.: "Functional interaction between the two halves of the photoreceptor-specific ATP binding cassette protein ABCR (ABCA4). Evidence for a non-exchangeable ADP in the first nucleotide binding domain.'; J Biol Chem. Oct. 10, 2003;278(41):39600-8) and those parts are expressed by two separate AAV vectors, or strategies that are based on the expression of small functional RNA molecules as in the case of a recent strategy to treat muscular dystrophy (Goyenvalle et al.: "Rescue of dystrophic muscle through U7 snRNA-mediated exon skipping"; Science. Dec. 3, 2004;306(5702):1796-9. Epub Nov. 4, 2004), or strategies where deletions are made within a functional protein to make its coding sequence fit within the assumed constraints of an AAV packaging limitation, such as in the case of CFTR [C] or microdystrophins (Liu et al.: "Adeno-associated virus-mediated microdystrophin expression protects young mdx muscle from contraction-induced injury."; Mol Ther. February 2005;11(2):245-56).

DETAILED DESCRIPTION OF THE INVENTION

The practice of the present invention will employ, unless otherwise indicated, conventional methods of virology, microbiology, molecular biology and recombinant DNA techniques within the skill of the art. Such techniques are explained fully in the literature; see, e.g., Sambrook, et al. Molecular Cloning: A Laboratory Manual (Current Edition); DNA Cloning: A Practical Approach, vol. I & II (D. Glover, ed.); Oligonucleotide Synthesis (N. Gait, ed., Current Edition); Nucleic Acid Hybridization (B. Hames & S. Higgins, eds., Current Edition); Transcription and Translation (B. Hames & S. Higgins, eds., Current Edition); CRC Handbook of Parvoviruses, vol. I & II (P. Tijessen, ed.); Fundamental Virology, 2nd Edition, vol. I & II (B. N. Fields and D. M. Knipe, eds.)

(1) Definitions

In describing the present invention, the following terms will be employed, and are intended to be defined as indicated below.

For purposes of this invention, the term "packaging limit" or "AAV packaging limit" means the maximum size of a (recombinant) AAV genome that can be packaged into an AAV capsid—independent of the titer or packaging efficacy or effective packaging capacity.

For purposes of this invention, the term "effective packaging capacity" or "effective AAV packaging capacity" means the size of a (recombinant) AAV genome that still allows for effective packaging of an AAV genome. Effective packaging refers to the genomic particle titer one can obtain per producer cell, where effective packaging is defined as a genomic particle titer of at least 500 genomic particles per producer cell, more preferentially of at least 1,000 genomic particles per producer cell, more preferentially of at least 2,000 genomic particles per producer cell, and most preferentially of at least 4,000 genomic particles per producer cell. Alternatively, the effective packaging refers to the genomic particle titer one can obtain per $cm^2$ of grwoth area for adherent producer cells, where effective packaging is defined as a genomic particle titer of at least $1.25 \times 10^8$ genomic particles per $cm^2$ of growth area, more preferentially of at least $2.5 \times 10^8$ genomic particles per $cm^2$ of growth area, more preferentially of at least $5 \times 10^8$ genomic particles per $cm^2$ of growth area, and most preferentially of at least $10^9$ genomic particles per $cm^2$ of growth area. The packaging limit is always equal or higher to the effective packaging capacity per definitionem.

For purposes of this invention, the term "protein" means a polypeptide (native [i.e., naturally-occurring] or mutant), oligopeptide, peptide, or other amino acid sequence. As used herein, "protein" is not limited to native or full-length proteins, but is meant to encompass protein fragments having a desired activity or other desirable biological characteristics, as well as mutants or derivatives of such proteins or protein fragments that retain a desired activity or other biological characteristic including peptoids with nitrogen based backbone. Mutant proteins encompass proteins having an amino acid sequence that is altered relative to the native protein from which it is derived, where the alterations can include amino acid substitutions (conservative or non-conservative), deletions, or additions (e.g., as in a fusion protein). "Protein" and "polypeptide" are used interchangeably herein without intending to limit the scope of either term.

For purposes of this invention, "amino acid" refers to a monomeric unit of a peptide, polypeptide, or protein. There are twenty amino acids found in naturally occurring peptides, polypeptides and proteins, all of which are L-isomers. The term also includes analogs of the amino acids and D-isomers of the protein amino acids and their analogs.

For purposes of this invention, by "DNA" is meant a polymeric form of desoxyribonucleotides (adenine, guanine, thymine, or cytosine) in double-stranded or single-stranded form, either relaxed or supercoiled, either linear or circular. This term refers only to the primary and secondary structure of the molecule, and does not limit it to any particular tertiary forms. Thus, this term includes single- and double-stranded DNA found, inter alia, in linear DNA molecules (e.g., restriction fragments), viruses, plasmids, and chromosomes. In discussing the structure of particular DNA molecules, sequences may be described herein according to the normal convention of giving only the sequence in the 5' to 3' direction along the non-transcribed strand of DNA (i.e., the strand having the sequence homologous to the mRNA). The term captures molecules that include the four bases adenine (A or a), guanine (G or g), thymine (T or t), or cytosine (C or c), as well as molecules that include base analogues which are known in the art.

For purposes of this invention, "polynucleotide" as used herein means a polymeric form of nucleotides of any length, either ribonucleotides or desoxyribonucleotides. This term refers only to the primary structure of the molecule. Thus, the term includes double- and single-stranded DNA, as well as, double- and single-stranded RNA. It also includes modifications, such as methylation or capping, and unmodified forms of the polynucleotide.

For the purpose of describing the relative position of nucleotide sequences in a particular nucleic acid molecule throughout the instant application, such as when a particular nucleotide sequence is described as being situated "upstream," "downstream," "5'," or "3'" relative to another sequence, it is to be understood that it is the position of the sequences in the non-transcribed strand of a DNA molecule that is being referred to as is conventional in the art.

For purposes of this invention, a "gene sequence" or "coding sequence" or "protein coding sequence" or "open reading frame" or "cDNA" or a sequence which "encodes" a particular protein, is a nucleic acid composition which is transcribed into RNA (in the case of DNA) and potentially translated (in the case of mRNA) into a polypeptide in vitro or in vivo when placed under the control of appropriate regulatory control elements. The boundaries of the gene are determined by a start codon at the 5' (amino) terminus and potentially a translation stop codon at the 3' (carboxy) terminus. A gene sequence can include, but is not limited to, cDNA from prokaryotic or eukaryotic mRNA, genomic DNA sequences from prokaryotic or eukaryotic DNA, and even synthetic DNA sequences. A transcription termination sequence, which is a particular species of regulatory control element, will usually be located 3' to the protein coding sequence.

For purposes of this invention, by the term "transgene" is meant a nucleic acid composition made out of DNA, which encodes a peptide, oligopeptide or protein. The transgene may be operatively linked to regulatory control elements in a manner which permits transgene transcription, translation and/or ultimately directs expression of a product encoded by the expression cassette in the producer cell, e.g., the transgene is placed into operative association with a promoter and enhancer elements, as well as other regulatory control elements, such as introns or polyA sequences, useful for its regulation. The composite association of the transgene with its regulatory sequences (regulatory control elements) is referred to herein as a "minicassette", "expression cassette", "transgene expression cassette", or "minigene". The exact composition of the expression cassette will depend upon the use to which the resulting (mini)gene transfer vector will be put and is known to the artisan (Sambrook 1989, Lodish et al. 2000). When taken up by a target cell, the expression cassette as part of the recombinant vector genome may remain present in the cell as a functioning extrachromosomal molecule, or it may integrate into the cell's chromosomal DNA, depending on the kind of transfer vector used. Generally, a minigene may have a size in the range of several hundred base pairs up to about 30 kb.

For purposes of this invention, "heterologous" as it relates to nucleic acid compositions denotes sequences that are not normally joined together. Thus, a "heterologous" region of a nucleic acid composition is a segment of nucleic acid within or attached to another nucleic acid composition that is not found in association with the other molecule in nature. For example, a heterologous region of a nucleic acid composition could include a coding sequence flanked by sequences not found in association with the coding sequence in nature. Another example of a heterologous coding sequence is a construct where the coding sequence itself is not found in nature (e.g., synthetic sequences having codons different from the native gene). Allelic variation or naturally occurring mutational events do not give rise to heterologous DNA, as used herein.

For purposes of this invention, "homology" or "homologous" refers to the percent homology between two polynucleotide moieties or two polypeptide moieties. The correspondence between the sequence from one moiety to another can be determined by techniques known in the art. Two DNA or two polypeptide sequences are "substantially homologous" to each other when at least about 80%, preferably at least about 90%, and most preferably at least about 95% of the nucleotides or amino acids match over a defined length of the molecules, as determined using methods in the art.

The techniques for determining amino acid sequence homology are well-known in the art. In general, "homology" (for amino acid sequences) means the exact amino acid to amino acid comparison of two or more polypeptides at the appropriate place, where amino acids are identical or possess similar chemical and/or physical properties such as charge or hydrophobicity. A so-termed "percent homology" then can be determined between the compared polypeptide sequences. The programs available in the Wisconsin Sequence Analysis Package (available from Genetics Computer Group, Madison, Wis.), for example, the GAP program, are capable of calculating homologies between two polypeptide sequences. In addition, the ClustalW algorithm is capable of performing a similar analysis. Other programs and algorithms for determining homology between polypeptide sequences are known in the art.

Homology for polynucleotides is determined essentially as follows: Two polynucleotides are considered to be "substantially homologous" to each other when at least about 80%, preferably at least about 90%, and most preferably at least about 95% of the nucleotides match over a defined length of the molecules, when aligned using the default parameters of the search algorithm BLAST 2.0. The BLAST 2.0 program is publicly available. The ClustalW algorithm can be utilized as well.

Alternatively, homology for polynucleotides can be determined by hybridization experiments. As used herein, a nucleic acid sequence or fragment (such as for example, primers or probes), is considered to selectively hybridize to a sequence 1, thus indicating "substantial homology", if such a sequence is capable of specifically hybridizing to the sequence 1 or a variant thereof or specifically priming a polymerase chain reaction: (i) under typical hybridization and wash conditions, such as those described, for example, in Maniatis, (Molecular Cloning: A Laboratory Manual, 2nd Edition, 1989) where preferred hybridization conditions are those of lesser stringency and more preferred, higher stringency; or (ii) using reduced stringency wash conditions that allow at most about 25-30% base pair mismatches, for example, 2.times.SSC, 0.1% SDS, at room temperature twice, for 30 minutes each; then 2×SSC, 0.1% SDS, 37° C., once for 30 minutes; the 2×SSC at room temperature twice, 10 minutes each or (iii) under standard PCR conditions or under "touch-down" PCR conditions.

For purposes of this invention, the term "cell" means any prokaryotic or eukaryotic cell, either ex vivo, in vitro or in vivo, either separate (in suspension) or as part of a higher structure such as but not limited to organs or tissues.

For purposes of this invention, the term "host cell" means a cell that can be transduced and/or transfected by an appropriate gene transfer vector. The nature of the host cell may vary from gene transfer vector to gene transfer vector.

For purposes of this invention, the term "producer cell" means a cell that is capable of producing (recombinant) AAV virions. The producer cell for rAAV virion production itself may be selected from any biological organism, including prokaryotic (e.g., bacterial) cells, and eukaryotic cells, including insect cells (such as Sf9 cells), yeast cells and mammalian cells (such as HEK 293 cells). Particularly desirable producer cells are selected from among any mammalian species, including, without limitation, cells such as HEK 293, A549, WEHI, 3T3, 10T1/2, BHK, MDCK, COS 1, COS 7, BSC 1, BSC 40, BMT 10, VERO, WI38, HeLa, Saos, C2C12, L cells, HT1080, HepG2 and primary fibroblast, hepatocyte and myoblast cells derived from mammals including human, monkey, mouse, rat, rabbit, and hamster. The selection of the mammalian species providing the cells is not a limitation of this invention; nor is the type of mammalian cell, i.e., fibroblast, hepatocyte, tumor cell, etc. Frequently used producer cells or HEK 293 cells. Preferentially, a producer cell should be free of potential adventitious viruses. Recently, AAV production in Sf9 insect cells has been described, which represents an alternative useful method to produce AAV (U.S. Pat. No. 6,723,551).

For purposes of this invention, the term "gene therapy" means the transfer of nucleic acid compositions into cells of a multicellular eukaryotic organism, be it in vivo, ex vivo or in vitro. The term "gene therapy" should not be limited to the purpose of correcting metabolic disorders, but be interpreted more as a technical term for the transfer of nucleic acid compositions, such as expression cassettes or minigenes, for therapeutic purposes in general, independent of a specific therapeutic purpose. Therefore, the term "gene therapy" would include—without limitation—correction of metabolic disorders, cancer therapy, vaccination, monitoring of cell populations, cell expansion, stem cell manipulation etc. by means of transfer of nucleic acid compositions.

For purposes of this invention, "transfection" is used to refer to the uptake of nucleic acid compositions by a cell. A cell has been "transfected" when an exogenous nucleic acid composition has crossed the cell membrane. A number of transfection techniques are generally known in the art. Such techniques can be used to introduce one or more nucleic acid compositions, such as a plasmid vector and other nucleic acid molecules, into suitable host cells. The term refers to both stable and transient uptake of the genetic material. For purposes of this invention, "transduction" is a special form of "transfection" via a viral vector.

For purposes of this invention, "transduction" denotes the delivery of a nucleic acid composition to, into or within a recipient cell either in vivo, in vitro or ex vivo, via a virus or viral vector, such as via a recombinant AAV virion. Transduction is a special form of transfection, i.e., the term transfection includes the term transduction.

For purposes of this invention, by "vector", "transfer vector", "gene transfer vector" or "nucleic acid composition transfer vector" is meant any element, such as a plasmid, phage, transposon, cosmid, chromosome, virus, virus capsid, virion, etc., which is capable of transferring and/or transporting a nucleic acid composition to a host cell, into a host cell and/or to a specific location and/or compartment within a host cell. Thus, the term includes cloning and expression vehicles, as well as viral and non-viral vectors and potentially naked or complexed DNA. However, the term does not include cells that produce gene transfer vectors such as retroviral packaging cell lines.

For purposes of this invention, by "recombinant virus", "recombinant virion", "recombinant vector" or "recombinant viral vector" is meant a virus that has been genetically altered, e.g., by the addition or insertion of a heterologous nucleic acid composition into the particle. Thus, for example, a "recombinant AAV virion" is used synonymously with a "recombinant AAV vector". A recombinant AAV vector comprises at least an AAV capsid ("the outer shell") and a recombinant AAV (vector) genome, which is harbored inside the capsid.

For purposes of this invention, by "recombinant AAV genome" or "recombinant AAV vector genome" is meant an AAV genome comprising heterologous sequences. In general, recombinant AAV genomes are designed in a fashion such that all viral genes are replaced by heterologous sequences (e.g., an expression cassette or minigene), leaving intact only the essential cis elements of the genome, i.e., the inverted terminal repeats (ITRs), DNA packaging signal, and the replication origin. Alternatively, the essential cis elements of the genome can be those as described in prior art by (Musatov et al.: "A cis-acting element that directs circular adeno-associated virus replication and packaging."; J Virol. December 2002;76(24):12792-802). The recombinant AAV genome is part of the recombinant AAV vector.

For purposes of this invention, a "self-complementary AAV vector" refers to

AAV vectors that utilize the tendency of AAV to package DNA dimers when the replicating genome is half the length of the wild type (wt). To produce these vectors efficiently, the terminal resolution site (trs) is deleted from one rAAV TR, preventing the initiation of replication at the mutated end. These constructs generate single-stranded, inverted repeat genomes, with a wt TR at each end, and a mutated TR in the middle. After uncoating, the viral DNA folds through intramolecular base pairing within the mutant TR, which then proceeds through the genome to form a double-stranded molecule. Those self-complementary AAV vectors can be used to overcome barriers to rAAV transduction and show faster onset of gene expression and higher transduction efficiency. A self-complementary AAV vector can also be produced by using a trans plasmid harboring a transgene expression cassette where said transgene expression cassette is flanked on one side by AAV2-ITRs and on the other side by AAV5-ITRs, and either AAV2-Rep functions or AAV5-Rep functions are used in AAV vector production.

For purposes of this invention, by "recombinant AAV vector construct" or "AAV vector construct" is meant a plasmid, cosmid, phage, virus or other nucleic acid composition that is used in the production of recombinant AAV virions. The recombinant AAV vector construct harbors the information of the recombinant AAV genome, i.e., the information for the genome to be packaged inside the (r)AAV capsids. One example of a recombinant AAV vector construct is a plasmid that comprises the information for a recombinant AAV genome and other nucleic acid sequences typical for plasmids (e.g., a replication of origin, an antibiotic resistance gene, etc.) The recombinant AAV vector construct is required for the production of recombinant AAV vector genomes. When a plasmid is used as recombinant AAV vector construct, it is referred to as "cis plasmid" or "AAV cis plasmid". In some instances, the author refers to a plasmid-based recombinant vector construct with the small letter "p" in front of the construct name; similarly, the author refers to the corresponding recombinant AAV virions with the small letter "v" in front of the virion name. For example, "pAAV eGFP" refers to a plasmid-based recombinant vector construct or "cis plasmid" harboring the genetic information to produce recombinant AAV genomes harboring an eGFP expression cassette. "vAAV eGFP" refers to a recombinant AAV virion harboring a recombinant AAV genome, where said recombinant AAV genome comprises an eGFP expression cassette. vAAV eGFP (virions) can be produced using pAAV eGFP as "cis plasmid" in combination with a corresponding packaging ("trans") plasmid and an Ad helper function plasmid.

For purposes of this invention, by "ABCR" is meant the translational product (protein) of the ABCA4 gene or ABCA4 coding sequence, or a protein substantially homologous to ABCR. The ABCR protein is referenced by SEQ ID NO: 2, the ABCA4 coding sequence is referenced by SEQ ID NO: 1. Mutations in the ABCA4 gene are responsible for Stargardt disease. One of ordinary skill in the art can make changes to the coding sequence (SEQ ID NO: 1) without changing the amino acid sequence of the resulting translation product (SEQ ID NO: 2). All those potential changes fall within the scope of the present invention.

For purposes of this invention, by "Factor VIII" or "Clotting Factor VIII" is meant the translational product (protein) of the Factor VIII gene or Factor VIII coding sequence, or a protein substantially homologous to Factor VIII. The Factor VIII protein is referenced by SEQ ID NO: 4, the Factor VIII coding sequence is referenced by SEQ ID NO: 3. Mutations in the Factor VIII gene are responsible for Hemophilia A. One of ordinary skill in the art can make changes to the coding sequence (SEQ ID NO: 3) without changing the amino acid sequence of the resulting translation product (SEQ ID NO: 4). All those potential changes fall within the scope of the present invention.

For purposes of this invention, by "B-deleted Factor VIII" or "B-deleted Clotting Factor VIII" or "B-domain deleted Factor VIII" or "B-domain deleted Clotting Factor VIII" is meant the translational product (protein) of a B-deleted Factor VIII minigene or B-deleted Factor VIII coding sequence, or a protein substantially homologous to B-deleted Factor VIII. B-deleted Factor VIII refers to a Factor VIII protein (as referenced in SEQ ID NO: 4) whose B-domain has been deleted either completely or partially. B-deleted Factor VIII proteins have been described in prior art (Ohlfest et al.: "Phenotypic correction and long-term expression of factor VIII in hemophilic mice by immunotolerization and nonviral gene transfer using the Sleeping Beauty transposon system."; Blood. Apr. 1, 2005; 105(7):2691-8). One B-deleted Factor VIII protein is referenced by SEQ ID NO: 6 and its corresponding coding sequence is referenced by SEQ ID NO: 5. One of ordinary skill in the art can make changes to the coding sequence (SEQ ID NO: 5) without changing the amino acid sequence of the resulting translation product (SEQ ID NO: 6). All those potential changes fall within the scope of the present invention.

For purposes of this invention, by "minidystrophin" is meant the translational product (protein) of a minidystrophin minigene or minidystrophin coding sequence, or a protein substantially homologous to a minidystrophin. Minidystrophin refers to a dystrophin protein (as referenced in SEQ ID NO: 7) with one or more deletion, where said deletion(s) do(es) not interfere significantly with dystrophin protein function, i.e., the minidystrophin can functionally replace the dystrophin. Minidystrophins have been described in prior art (Deconinck et al.: "Functional protection of dystrophic mouse (mdx) muscles after adenovirus-mediated transfer of a dystrophin minigene."; Proc Natl Acad Sci USA. Apr. 16, 1996;93(8):3570-4). One minidystrophin protein is referenced by SEQ ID NO: 9 and its corresponding coding sequence is referenced by SEQ ID NO: 8. One of ordinary skill in the art can make changes to the coding sequence (SEQ ID NO: 8) without changing the amino acid sequence of the resulting translation product (SEQ ID NO: 9). All those potential changes fall within the scope of the present invention.

For purpose of this invention, the term "ABCR expression cassette", "ABCR transgene expression cassette", "ABCR inducing minigene", "ABCR minigene" refers to a minigene comprising a nucleic acid composition whose expression directly or indirectly leads to the expression of ABCR or a protein substantially homologous to ABCR in the transduced host cell upon AAV-mediated gene transfer. This invention claims all theoretically possible nucleic acid compositions of ABCR inducing minigenes whose transduction of host cells will lead either indirectly or directly to the expression and/or synthesis of ABCR.

For purpose of this invention, the term "Factor VIII expression cassette", "Factor VIII transgene expression cassette", "Factor VIII inducing minigene", "Factor VIII minigene" refers to a minigene comprising a nucleic acid composition whose expression directly or indirectly leads to the expression of Factor VIII or a protein substantially homologous to Factor VIII in the transduced host cell upon AAV-mediated gene transfer. This invention claims all theoretically possible nucleic acid compositions of Factor VIII inducing minigenes whose transduction of host cells will lead either indirectly or directly to the expression and/or synthesis of Factor VIII.

For purpose of this invention, the term "B-deleted Factor VIII expression cassette", "B-deleted Factor VIII transgene expression cassette", "B-deleted Factor VIII inducing minigene", "B-deleted Factor VIII minigene" refers to a minigene comprising a nucleic acid composition whose expression directly or indirectly leads to the expression of B-deleted Factor VIII or a protein substantially homologous to B-deleted Factor VIII in the transduced host cell upon AAV-mediated gene transfer. This invention claims all theoretically possible nucleic acid compositions of B-deleted Factor VIII inducing minigenes whose transduction of host cells will lead either indirectly or directly to the expression and/or synthesis of B-deleted Factor VIII.

For purpose of this invention, the term "minidystrophin expression cassette", "minidystrophin transgene expression cassette", "minidystrophin inducing minigene", "minidystrophin minigene" refers to a minigene comprising a nucleic acid composition whose expression directly or indirectly leads to the expression of minidystrophin or a protein substantially homologous to minidystrophin in the transduced host cell upon AAV-mediated gene transfer. This invention claims all theoretically possible nucleic acid compositions of minidystrophin inducing minigenes whose transduction of host cells will lead either indirectly or directly to the expression and/or synthesis of minidystrophin.

For purposes of this invention, by "AAV virion" is meant a complete virus particle, such as a wild-type (wt) AAV virus particle (comprising a linear, single-stranded AAV nucleic acid genome associated with an AAV capsid protein coat). In this regard, single-stranded AAV nucleic acid molecules of either complementary sense, e.g., "sense" or "antisense" strands, can be packaged into any one AAV virion, and both strands are equally infectious.

For purposes of this invention, by "recombinant virus", "recombinant virion", "recombinant vector" or "recombinant viral vector" is meant a virus that has been genetically altered, e.g., by the addition or insertion of a heterologous nucleic acid composition into the particle.

For purposes of this invention, by "(recombinant) AAV vector", "(recombinant) AAV-based vector", "(recombinant) adeno-associated virus based vector" or "(recombinant) adeno-associated viral vector" is meant a vector as follows (with vector or virion being used synonymously):

(1) A vector derived from an adeno-associated virus serotype, including without limitation, AAV1, AAV2, AAV3, AAV3b, AAV4, AAV5, AAV6, AAV7, AAV8, AAV9, AAV10, AAV11 etc.; or
(2) A vector derived from any other virus or serotype which is substantially homologous in its capsid protein sequence to the AAV2 or AAV5 capsid protein sequence; or
(3) A vector derived from any other virus or serotype which allows packaging of a (recombinant) AAV genome with AAV2-ITRs; or
(4) A vector derived from any other virus or serotype which allows packaging of a (recombinant) AAV genome with AAV5-ITRs.

AAV vectors, which is synonymously used to (recombinant) AAV (vector) genomes, can have one or more of the AAV wild-type genes deleted in whole or in part, preferably the rep and/or cap genes, but retain functional flanking ITR sequences. Functional ITR sequences are necessary for the rescue, replication and packaging of the AAV virion. Thus, an AAV vector is defined herein to include at least those sequences required in cis for replication and packaging (e.g., functional ITRs) of the virus. The ITRs need not be the wild-type nucleotide sequences, and may be altered, e.g., by the insertion, deletion or substitution of nucleotides, as long as the sequences provide for functional rescue, replication and packaging.

The term also includes hybrid vectors combining characteristics of more than one AAV serotype. For example, hybrid AAV vectors can combine hybrid capsids, i.e., capsids comprising capsid proteins from more than one serotype. Alternatively, hybrid AAV vectors can harbor a recombinant AAV genome of one serotype packaged into the capsid of an AAV of a different serotype.

A recombinant AAV virion (vector) or rAAV virion (vector) is further defined herein as an infectious, replication-defective virus composed of an AAV protein shell, encapsidating a heterologous DNA molecule of interest which is flanked on one or both sides by AAV ITRs. The AAV ITRs can be of the same serotype or originate from different serotypes. A rAAV virion is produced in a suitable host cell which has had an AAV vector construct, AAV helper functions and accessory functions introduced therein. In this manner, the host cell is rendered capable of encoding AAV polypeptides that are required for packaging the AAV vector genome (comprising a recombinant nucleotide sequence of interest) into recombinant virion particles for subsequent gene delivery. The term "rAAV virion" and its synonyms and the term "AAV vector" and its synonyms can be used interchangeably.

For purposes of this invention, "pseudotyped" rAAV vector refers to a recombinant AAV vector in which the capsid protein is of a serotype heterologous to the serotype(s) of the ITRs of the minigene. For example, a pseudotyped rAAV may be composed of a minigene carrying AAV5 ITRs and capsid of AAV2, AAV1, AAV3, AAV4, AAV6, AAV7, AAV8 or another suitable AAV serotype, where the minigene is packaged in the heterologous capsid. Alternatively, a pseudotyped rAAV vector may be composed of an AAV5 capsid which has packaged therein a minigene containing ITRs from at least one of the other serotypes. Particularly desirable rAAV composed of AAV5 are described in U.S. Patent Application Ser. No. 60/200,409, filed Apr. 28, 2000 and International Patent Application No. PCT/USO1/13000, filed Apr. 23, 2001, both of which are incorporated by reference herein. For example, an AAV virion harboring a recombinant AAV genome with AAV2-ITRs in a capsid of AAV serotype 5 is referred to as AAV2/5 virion or AAV2:2/5 virion. Similarly, a recombinant AAV virion harboring a recombinant AAV genome with AAV5-ITRs in a capsid of AAV serotype 2 is referred to as AAV5/2 virion or AAV5:5/2 virion. Similarly, an AAV virion harboring a recombinant AAV genome with a 5'-AAV2-ITR and a 3'-AAV5-ITR in a capsid of AAV serotype 7 is referred to as AAV2:5/7 virion. Thus, the general nomenclature for AAV virions is: AAV:[AAV-5'-ITR]:[AAV-3'-ITR]/[AAV capsid].

As defined herein, AAV capsid proteins include hybrid capsid proteins which contain a functional portion of one or more AAV capsid proteins. Such hybrid capsid proteins may be constructed such that a fragment of a capsid derived from one serotype is fused to a fragment of a capsid from another serotype to form a single hybrid capsid which is useful for packaging of (recombinant) AAV genomes.

For purposes of this invention, "treatment" refers to prophylaxis and/or therapy.

"Pharmaceutically effective" levels are levels sufficient to achieve a physiologic effect in a human or veterinary subject, which effect may be therapeutic or prophylactic.

For purposes of this invention, by "mammalian subject" is meant any member of the class Mammalia including, without limitation, humans and nonhuman primates such as chimpanzees and other apes and monkey species; farm animals such as cattle, sheep, pigs, goats and horses; domestic mammals such as dogs and cats; laboratory animals including rodents such as mice, rats and guinea pigs, and the like. The term does not denote a particular age or sex. Thus, adult and newborn subjects, as well as fetuses, whether male or female, are intended to be covered.

For purposes of this invention, the terms "individual" or "subject" or "patient" as used herein refer to vertebrates, particularly members of the mammalian species and include but are not limited to domestic animals, sports animals, primates and humans; more particularly the term refer to humans.

For purposes of this invention, the term "control elements", "regulatory sequences" or "regulatory control elements" refers collectively to promoter regions, polyadenylation signals, transcription termination sequences, upstream regulatory domains, origins of replication, internal ribosome entry sites ("IRES"), enhancers, and the like, which collectively provide for the replication, transcription and translation of a coding sequence in a recipient cell. Not all of these control elements need always be present as long as the selected coding sequence is capable of being replicated, transcribed and/ or translated in an appropriate host cell. Sometimes, the entirety of control elements and coding sequence is referred to as "gene"; in other instances, "gene" only refers to the coding sequence. For purposes of this invention, "gene" refers to the entirety of control elements and coding sequence. Expression control elements include appropriate transcription initiation, termination, promoter and enhancer sequences, efficient RNA processing signals such as splicing and polyadenylation signals, sequences that stabilize cytoplasmic mRNA, sequences that enhance translation efficacy (i.e., Kozak consensus sequence), sequences that enhance protein stability, and when desired, sequences that enhance protein processing and/or secretion. A great number of expression control elements, e.g., native, constitutive, inducible and/or tissue specific, are known in the art and may be utilized to drive expression of the gene, depending upon the type of expression desired. For eukaryotic cells, expression control elements typically include a promoter, an enhancer, such as one derived from an immunoglobulin gene, SV40, cytomegalovirus, etc., a polyadenylation sequence, and may include splice donor and acceptor sites. The polyadenylation sequence generally is inserted following the transgene sequences and before the 3' ITR sequence in rAAV vectors.

The regulatory sequences useful in the constructs of the present invention may also contain an intron, desirably located between the promoter/enhancer sequence and the gene. One possible intron sequence is derived from SV40, and is referred to as the SV40 T intron sequence. Another suitable regulatory sequence includes the woodchuck hepatitis virus post-transcriptional element. Still other methods may involve the use of a second internal promoter, an alternative splice signal, a co- or post-translational proteolytic cleavage strategy, among others which are known to those of skill in the art. Selection of these and other common vector and regulatory sequences are conventional, and many such sequences are available. See, e.g., Sambrook et al, and references cited therein at, for example, pages 3.18-3.26 and 16.17-16.27 and Ausubel et al., CURRENT PROTOCOLS IN MOLECULAR BIOLOGY, John Wiley & Sons, New York, 1989.

One of skill in the art may make a selection among these regulatory sequences without departing from the scope of this invention. Suitable promoter/enhancer sequences may be selected by one of skill in the art using the guidance provided by this application. Such selection is a routine matter and is not a limitation of the present invention. For instance, one may select one or more regulatory sequences operably linked to the ABCA4 coding sequence as expression cassette for insertion into a rAAV vector construct which is composed of the 5' ITRs, the ABCA4 expression cassette, and 3' ITRs in the context of rAAV vectors. Thus, this system permits a great deal of latitude in the selection of the various components of the minigene. Provided with the teachings of this invention, the design of such a minigene can be made by resort to conventional techniques.

For purposes of this invention, the term "promoter" means a regulatory sequence capable of binding RNA polymerase and/or a regulatory sequence sufficient to direct transcription. "Promoter" is also meant to encompass those promoter (or enhancer) elements for cell-type specific, tissue-specific and/or inducible (by external signals or agents) transcription; such elements may be located in the 5' or 3' regions of a native gene.

In some embodiments, tissue-specific promoters are desired. Examples of such tissue-specific promoters include the MCK promoter for muslce-directed gene expression (referenced by SEQ ID NO: 63), the TBG promoter for liver-directed gene expression (referenced by SEQ ID NO: 11), or the Rhodopsin Kinase promoter for photoreceptor-directed gene expression (referenced by SEQ ID NO: 12). Tissue-specific promoters can be readily selected by one of skill in the art for use in the invention without undue efforts. Alternatively, non-tissue-specific promoters may be readily selected.

In another embodiment, high-level constitutive expression is desired. Examples of such promoters include, without limitation, the retroviral Rous sarcoma virus (RSV) LTR promoter (referenced by SEQ ID NO: 13, optionally with the RSV enhancer), the cytomegalovirus (CMV) promoter (referenced by SEQ ID NO: 14, optionally with the CMV enhancer), the SV40 promoter, the dihydrofolate reductase promoter, the β-actin promoter (referenced by SEQ ID NO: 15), the phosphoglycerol kinase (PGK) promoter (referenced by SEQ ID NO: 16), and the EF1α promoter.

Inducible promoters are regulated by exogenously supplied compounds, including, the zinc-inducible sheep metallothionine (MT) promoter, the dexamethasone (Dex)-inducible mouse mammary tumor virus (MMTV) promoter, the T7 polymerase promoter system, the SP6 polymerase promoter system; the ecdysone insect promoter, the tetracycline-repressible system, the tetracycline-inducible system, the RU486-inducible system, and the rapamycin-inducible system. Other types of inducible promoters which may be useful in the transgenes and other constructs described herein are those which are regulated by a specific physiological state, e.g., temperature, acute phase, a particular differentiation state of the cell, or in replicating cells only.

For purposes of this invention, the term "operative association" or "operative linkage" refers to an arrangement of elements or nucleic acid sequences wherein the components so described are configured so as to perform their intended function. Thus, (a) regulatory sequence(s) operably linked to a coding sequence is/are capable of effecting the expression of said coding sequence and is/are connected in such a way as to permit gene expression of the coding sequence when the appropriate molecules (e.g., transcriptional activator proteins) are bound to the regulatory sequence(s). The regulatory sequences need not be contiguous with the coding sequence, as long as they function to direct the expression thereof. Thus, for example, intervening untranslated yet transcribed sequences can be present between a promoter sequence and the coding sequence and the promoter sequence can still be considered "operably linked" to the coding sequence. "Operably linked" sequences include both expression control sequences that are contiguous with the coding sequences for the product of interest and expression control sequences that act in trans or at a distance to control the expression of the product of interest.

(2) General Methods

The practice of the present invention will employ, unless otherwise indicated, conventional methods of virology, microbiology, molecular biology and recombinant DNA techniques within the skill of the art. Such techniques are explained fully in the literature; see, e.g., Sambrook, et al. Molecular Cloning: A Laboratory Manual (Current Edition); DNA Cloning: A Practical Approach, vol. I & II (D. Glover, ed.); Oligonucleotide Synthesis (N. Gait, ed., Current Edition); Nucleic Acid Hybridization (B. Hames & S. Higgins, eds., Current Edition); Transcription and Translation (B. Hames & S. Higgins, eds., Current Edition); CRC Handbook of Parvoviruses, vol. I & II (P. Tijessen, ed.); Fundamental Virology, 2nd Edition, vol. I & II (B. N. Fields and D. M. Knipe, eds.)

(a) Recombinant AAV Virions

The recombinant AAV virions of the invention can be produced using standard methodology, known to the artisan. The methods generally involve the steps of (1) Introducing an (r)AAV vector construct into a producer cell (e.g., 293 cells);
(2) Introducing an "AAV packaging construct" into the producer cell, where the packaging construct includes AAV coding regions (e.g., rep and cap sequences) capable of being expressed in the producer cell to complement AAV packaging functions missing from the AAV vector construct; plasmid-based AAV packaging constructs are often referred to as "trans" plasmids;
(3) Introducing one or more helper viruses and/or accessory function vector constructs into the producer cell, wherein the helper virus and/or accessory function vector constructs provide accessory functions capable of supporting efficient recombinant AAV ("rAAV") virion production in the producer cell; frequently used producer cells are HEK 293 cells and Sf9 cells; and
(4) Culturing the producer cell to produce rAAV virions;
(5) Harvesting the cells and isolating/purifying the rAAV virions.

The AAV vector construct, AAV packaging construct and the helper virus or accessory function vector construct can be introduced into the producer cell either simultaneously or serially, using standard transfection techniques.

Introduction of the molecules (as plasmids or viruses) into the producer cell may also be accomplished using techniques known to the skilled artisan and are discussed throughout the specification. In the preferred embodiment, standard transfection techniques are used, e.g., calcium phosphate transfection or electroporation, and/or infection by hybrid adenovirus/AAV vectors into cell lines such as the human embryonic kidney cell line HEK 293 (a human kidney cell line containing functional adenovirus E1 genes which provides trans-acting E1 proteins). Thus produced, the rAAV may be used to prepare the compositions and kits described herein, and used in the method of the invention.

Recently, a method for producing rAAV virions in insect cells has been described (U.S. Pat. No. 6,723,551).

(b) Recombinant AAV Vector Constructs

Recombinant AAV vector constructs are constructed using known techniques to at least provide, as operatively linked components in the direction of transcription, (a) control elements including a transcriptional initiation region, (b) the DNA of interest, and (c) a transcriptional termination region. The control elements are selected to be functional in the targeted cell. The resulting construct which contains the operatively linked components is bounded (5' and 3') with functional AAV ITR sequences (in the preferred embodiment AAV2-ITR sequences). Alternatively, the construct may contain the replication origin as described in (Musatov et al.: "A cis-acting element that directs circular adeno-associated virus replication and packaging."; J Virol. December 2002;76(24): 12792-802).

The nucleotide sequences of AAV ITR regions are known. AAV ITRs used in the vectors of the invention need not have a wild-type nucleotide sequence, and may be altered, e.g., by the insertion, deletion or substitution of nucleotides. Also, in some embodiments, the 5'-ITR and the 3'-ITR might be derived from different serotypes, e.g., an AAV2-5'-ITR and an AAV5-3'-ITR.

Additionally, AAV ITRs may be derived from any of several AAV serotypes, including AAV1, AAV2, AAV3, AAV4, AAV5, AAV6, AAV7, AAV8, AAV9, AAV10, AAV11, avian AAVs, bovine AAVs etc. The 5' and 3' ITRs which flank a selected transgene expression cassette in an AAV vector construct need not necessarily be identical or derived from the same AAV serotype. Thus, rAAV vector design and production allow for exchanging the capsid proteins between different AAV serotypes: Homologous vectors comprising an expression cassette flanked by e.g., AAV2-ITRs and packaged in an AAV2 capsid, can be produced as well as heterologous, hybrid vectors where the transgene expression cassette is flanked by e.g., AAV2 ITRs, but the capsid originates from another AAV serotype such as AAV5 for example.

The AAV sequences used in generating the minigenes, vectors, and capsids, and other constructs used in the present invention may be obtained from a variety of sources. For example, the sequences may be provided by AAV serotype 5, AAV serotype 2, AAV serotype 1, AAV serotype 3, AAV serotype 4, AAV serotype 6, or other AAV serotypes or other densoviruses. A variety of these viral serotypes and strains are available from the American Type Culture Collection, Manassas, Va., or are available from a variety of academic or commercial sources (e.g., Stratagene GmbH, Germany). Alternatively, it may be desirable to synthesize sequences used in preparing the vectors and viruses of the invention using known techniques, which may utilize AAV sequences which are published and/or available from a variety of databases.

The source of the sequences utilized in preparation of the constructs of the invention is not a limitation of the present invention. Moreover, commercial services do exist that produce any desired nucleotide sequence even comprising several kilobase pairs including complete recombinant AAV vector constructs in plasmid backgrounds (e.g., Invitrogen, Carlsbad, USA; Geneart, Germany.) Thus, with the sequences disclosed in the present invention, the artisan is able to order the corresponding plasmids from commercial services. Alternatively, some plasmids have already been published elsewhere. Moreover, the plasmid constructs used and disclosed in the present invention can also be obtained from the inventor unlesss they are sold commercially or are protected by a Material Transfer Agreement from a third party. The inventor can be contacted via e-mail at hildinger@gmx.net.

(c) rAAV Virion Production

In order to produce rAAV virions, an AAV vector construct that has been constructed as described is introduced into a suitable producer cell using known techniques such as by transfection. A number of transfection techniques are generally known in the art, see, e.g., Graham and van der Eb 1973. Moreover, many commercial kits are available; those kits also teach how to transfect cells with DNA.

The AAV vector construct harboring the recombinant AAV genome of the present invention is preferably carried on a plasmid which is delivered to a producer cell by transfection. These plasmids (or other constructs harboring a sequence comprising 5'AAV-ITR & heterologous molecule & 3'AAV-ITR) may contain sequences permitting replication of the genetic information for the recombinant AAV genome in eukaryotes and/or prokaryotes and selection markers for these systems. Selectable markers or reporter genes may include sequences encoding geneticin, hygromycin or puromycin resistance, among others. The plasmids may also contain certain selectable reporters or marker genes that can be used to signal the presence of the plasmid in bacterial cells, such as ampicillin or kanamycin resistance. Other components of the plasmid may include an origin of replication and an amplicon, such as the amplicon system employing the Epstein Barr virus nuclear antigen. This amplicon system or other similar amplicon components permit high copy episomal replication in the cells. Preferably, the molecule carrying the AAV minigene is transfected into the cell, where it may exist transiently as an episome. Alternatively, the recombinant AAV genome (comprising the 5'AAV-ITR & heterologous molecule & 3'AAV-ITR) may be stably integrated into a chromosome of the producer cell in a double-stranded form. Suitable transfection techniques are known and may readily be utilized to deliver the AAV vector construct to the producer cell.

Generally, when delivering the AAV vector construct comprising the information for the recombinant AAV genome by transfection, the construct is delivered in an amount from about 5 µg to about 100 µg DNA, and preferably about 10 to about 50 µg DNA to about $10^4$ cells to about $10^{13}$ cells, and preferably about $10^5$ cells. However, the relative amounts of vector DNA to producer cells may be adjusted, taking into consideration such factors as the selected vector, the delivery method and the producer cells selected.

For the purposes of the invention, suitable producer cells for producing rAAV virions include microorganisms, yeast cells, insect cells, and mammalian cells, that can be, or have been, used for transfection. The term includes the progeny of the original cell which has been transfected. Thus, a "producer cell" as used herein generally refers to a cell which has been transfected with an exogenous DNA sequence. Cells from the stable human cell line 293 (readily available through, e.g., the ATCC under Accession No. ATCC CRL1573) are preferred in the practice of the present invention. The human cell line 293 is a human embryonic kidney cell line that has been transformed with adenovirus type-5 DNA fragments (Graham, Smiley et al. 1977), and expresses the adenoviral E1a and E1b genes (Aiello, Guilfoyle et al. 1979). The 293 cell line is readily transfected, and provides a particularly convenient platform in which to produce rAAV virions.

The components required to be cultured in the producer cell to package the recombinant AAV genome in the AAV capsid may be provided to the producer cell in trans. Alternatively, any one or more of the required components (e.g., recombinant AAV genome, rep sequences, cap sequences, and/or accessory functions) may be provided by a stable producer cell which has been engineered to contain one or more of the required components using methods known to those of skill in the art.

The recombinant AAV genome, rep sequences, cap sequences, and accessory (helper) functions required for producing the rAAV of the invention may be delivered to the packaging producer cell in the form of any genetic element, e.g., naked DNA, a plasmid, phage, transposon, cosmid, virus, etc. which transfer the sequences carried thereon. The selected genetic element may be delivered by any suitable method, including transfection, electroporation, liposome delivery, membrane fusion techniques, high velocity DNA-coated pellets, viral infection and protoplast fusion.

(d) AAV Packaging Functions

Producer cells containing the above described AAV vector constructs must be rendered capable of providing AAV packaging functions in order to replicate and encapsidate the nucleotide sequences flanked by the AAV ITRs to produce rAAV virions. AAV packaging functions are generally AAV-derived coding sequences which can be expressed to provide AAV gene products that, in turn, function in trans for productive AAV replication and genome encapsidation. AAV packaging functions are used herein to complement necessary AAV functions that are missing from the AAV vector constructs. Thus, AAV packaging functions include one, or both of the major AAV ORFs, namely the rep and cap coding regions, or functional homologues thereof.

By "AAV rep coding region" is meant the art-recognized region of the AAV genome which encodes the replication proteins Rep78, Rep68, Rep52 and Rep40. These Rep expression products have been shown to possess many functions, including recognition, binding and nicking of the AAV origin of DNA replication, DNA helicase activity and modulation of transcription from AAV (or other heterologous) promoters. The Rep expression products are collectively required for replicating the AAV genome. For a description of the AAV rep coding region, see, e.g., (Muzyczka 1992; Kotin 1994). Suitable homologues of the AAV rep coding region include the human herpesvirus 6 (HHV-6) rep gene which is also known to mediate AAV-2 DNA replication (Thomson, Weindler et al. 1994).

By "AAV cap coding region" is meant the art-recognized region of the AAV genome which encodes the capsid proteins VP1, VP2, and VP3, or functional homologues thereof. These cap expression products supply the packaging functions which are collectively required for packaging the viral genome. For a description of the AAV cap coding region, see, e.g., (Muzyczka 1992; Kotin 1994).

AAV packaging functions are introduced into the producer cell by transfecting the producer cell with an AAV packaging construct either prior to, or concurrently with, the transfection of the AAV vector construct. AAV packaging constructs are thus used to provide at least transient expression of AAV rep and/or cap genes to complement missing AAV functions that are necessary for productive AAV infection. AAV packaging constructs lack AAV ITRs and can neither replicate nor package themselves. These constructs can be in the form of a plasmid, phage, transposon, cosmid, virus, or virion. A number of AAV packaging constructs have been described, such as the commonly used plasmids pAAV/Ad and pIM29+45 which encode both Rep and Cap expression products. See, e.g., (Samulski, Chang et al. 1989; McCarty, Christensen et al. 1991). A number of other vectors have been described which encode Rep and/or Cap expression products. See, e.g., U.S. Pat. No. 5,139,941.

The AAV packaging construct used in the present invention to create recombinant AAV5 virions is referenced by SEQ ID NO: 17 (the trans plasmid pack 2/5). The AAV packaging construct used in the present invention to create recombinant AAV7 virions is referenced by SEQ ID NO: 18 (the trans plasmid pack 2/7). The AAV packaging construct used in the present invention to create recombinant AAV8 virions is referenced by SEQ ID NO: 19 (the trans plasmid pack 2/8). The AAV packaging construct used in the present invention to create recombinant AAV2 virions is referenced by SEQ ID NO: 20 (the trans plasmid pack 2/2). The AAV packaging construct used in the present invention to create recombinant AAV1 virions is referenced by SEQ ID NO: 21 (the trans plasmid pack 2/1). The AAV packaging construct used in the present invention to create recombinant BAAV virions is referenced by SEQ ID NO: 22 (the trans plasmid pack 2/BAAV).

Additionally, when pseudotyping an AAV vector in a different AAV capsid, the sequences encoding each of the essential Rep proteins may be supplied by the same AAV serotype as the ITRs, or the sequences encoding the Rep proteins may be supplied by different, but cross-reactive, AAV serotypes. For example, the Rep78/68 sequences may be from AAV2, whereas the Rep52/40 sequences may be from AAV1.

Thus, in one embodiment, the rep and cap sequences may be transfected into the producer cell on a single nucleic acid molecule and exist in the cell as an episome. In another embodiment, the rep and cap sequences are stably integrated into the genome of the cell. Another embodiment has the rep and cap sequences transiently expressed in the producer cell. For example, a useful nucleic acid molecule for such transfection comprises, from 5' to 3', a promoter, an optional spacer interposed between the promoter and the start site of the rep gene sequence, an AAV rep gene sequence, and an AAV cap gene sequence.

Optionally, the rep and/or cap sequences may be supplied on a vector that contains other DNA sequences that are to be introduced into the producer cells. For instance, the vector may contain the rAAV vector construct comprising the AAV minigene. The vector may comprise one or more of the genes encoding the helper functions, e.g., the adenoviral proteins E1, E2a, and E40RF6, and the gene for VAI RNA.

In another embodiment, the promoter for rep is an inducible promoter, as discussed above in connection with regulatory sequences and promoters. One preferred promoter for rep expression is the T7 promoter. The vector comprising the rep gene regulated by the T7 promoter and the cap gene, is transfected or transduced into a cell which either constitutively or inducibly expresses the T7 polymerase. See WO 98/10088, published Mar. 12, 1998.

Preferably, the promoter used in the AAV packaging construct may be any of the constitutive, inducible or native promoters known to one of skill in the art or as discussed above. In one embodiment, an AAV p5 promoter sequence is employed. The selection of the AAV to provide any of these sequences does not limit the invention.

The spacer is an optional element in the design of the AAV packaging construct. The spacer is a DNA sequence interposed between the promoter and the rep gene ATG start site. The spacer may have any desired design; that is, it may be a random sequence of nucleotides, or alternatively, it may encode a gene product, such as a marker gene. The spacer may contain genes which typically incorporate start/stop and polyA sites. The spacer may be a non-coding DNA sequence from a prokaryote or eukaryote, a repetitive non-coding sequence, a coding sequence without transcriptional controls or a coding sequence with transcriptional controls. Two exemplary sources of spacer sequences are the X phage ladder sequences or yeast ladder sequences, which are available commercially, e.g., from Gibco or Invitrogen, among others. The spacer may be of any size sufficient to reduce expression of the rep78 and rep68 gene products, leaving the rep52, rep40 and cap gene products expressed at normal levels. The length of the spacer may therefore range from about 10 bp to about 10.0 kbp, preferably in the range of about 100 bp to about 8.0 kbp. To reduce the possibility of recombination, the spacer is preferably less than 2 kbp in length; however, the invention is not so limited.

(e) Accessory Functions

The producer cell (or packaging cell) must also be rendered capable of providing non AAV derived functions, or "accessory functions", in order to produce rAAV virions. Accessory functions are non AAV derived viral and/or cellular functions upon which AAV is dependent for its replication. Thus, accessory functions include at least those non AAV proteins and RNAs that are required in AAV replication and packaging, including those involved in activation of AAV gene transcription, stage specific AAV mRNA splicing, AAV DNA replication, synthesis of rep and cap expression products and AAV capsid assembly. Viral-based accessory functions can be derived from any of the known helper viruses.

Particularly, accessory functions can be introduced into and then expressed in producer cells using methods known to those of skill in the art. Commonly, accessory functions are provided by infection of the producer cells with an unrelated helper virus. A number of suitable helper viruses are known, including adenoviruses, herpes viruses such as Herpes Simplex Virus types 1 and 2, and vaccinia viruses. Non-viral accessory functions will also find use herein, such as those provided by cell synchronization using any of various known agents (Buller, Janik et al. 1981; McPherson, Rosenthal et al. 1985; Schlehofer, Ehrbar et al. 1986). Alternatively and preferentially, accessory functions can be provided using an accessory function vector construct such as a plasmid harboring the genetic information for said accesory functions. In case those accesory functions are derived from Adenovirus, such a plasmid is referred to as Ad helper plasmid or Adenovirus helper plasmid or Ad helper function plasmid, or Adenovirus helper function plasmid.

Accessory function vector constructs include nucleotide sequences that provide one or more accessory functions. An accessory function vector is capable of being introduced into a suitable producer cell in order to support efficient AAV virion production in the producer cell. Accessory function vectors can be in the form of a plasmid, phage, virus, transposon or cosmid. Accessory vector constructs can also be in the form of one or more linearized DNA or RNA fragments which, when associated with the appropriate control elements and enzymes, can be transcribed or expressed in a producer cell to provide accessory functions.

Nucleic acid sequences providing the accessory functions can be obtained from natural sources, such as from the genome of adenovirus (especially Adenovirus serotype 5), or constructed using recombinant or synthetic methods known in the art. In this regard, adenovirus-derived accessory functions have been widely studied, and a number of adenovirus genes involved in accessory functions have been identified and partially characterized. See, e.g., Carter, B. J. (1990) "Adeno-Associated Virus Helper Functions," in CRC Handbook of Parvoviruses, vol. I (P. Tijssen, ed.), and (Muzyczka 1992). Specifically, early adenoviral gene regions E1a, E2a, E4, VAI RNA and, possibly, E1b are thought to participate in the accessory process (Janik, Huston et al. 1981). Herpes Virus-derived accessory functions have been described as well (Young and Mayor 1979). Vaccinia virus-derived accessory functions have also been described (Schlehofer, Ehrbar et al. 1986).

Most desirably, the necessary accessory functions are provided from an adenovirus source. In one embodiment, the producer cell is provided with and/or contains an E1a gene product, an E1b gene product, an E2a gene product, and/or an E40RF6 gene product. The producer cell may contain other adenoviral genes such as VAI RNA, but these genes are not required. In a preferred embodiment, no other adenovirus genes or gene functions are present in the producer cell. The DNA sequences encoding the adenovirus E4 ORF6 genes and the E1 genes and/or E2a genes useful in this invention may be selected from among any known adenovirus type, including the presently identified 46 human types [see, e.g., American Type Culture Collection]. Similarly, adenoviruses known to infect other animals may supply the gene sequences. The selection of the adenovirus type for each E1, E2a, and E4 ORF6 gene sequence does not limit this invention. The sequences for a number of adenovirus serotypes, including that of serotype Ad5, are available from Genbank. A variety of adenovirus strains are available from the American Type Culture Collection (ATCC), Manassas, Va., or are available by request from a variety of commercial and institutional sources. Any one or more of human adenoviruses Types 1 to 46 may supply any of the adenoviral sequences, including E1, E2a, and/or E4 ORF6.

The adenovirus E1a, E1b, E2a, and/or E40RF6 gene products, as well as any other desired accessory functions, can be provided using any means that allows their expression in a cell. Each of the sequences encoding these products may be on a separate vector, or one or more genes may be on the same vector. The vector may be any vector known in the art or disclosed above, including plasmids, cosmids and viruses. Introduction into the producer cell of the vector may be achieved by any means known in the art or as disclosed above, including transfection, infection, electroporation, liposome delivery, membrane fusion techniques, high velocity DNA-coated pellets, viral infection and protoplast fusion, among others. One or more of the adenoviral genes may be stably integrated into the genome of the producer cell, stably expressed as episomes, or expressed transiently. The gene products may all be expressed transiently, on an episome or stably integrated, or some of the gene products may be expressed stably while others are expressed transiently. Furthermore, the promoters for each of the adenoviral genes may be selected independently from a constitutive promoter, an inducible promoter or a native adenoviral promoter. The promoters may be regulated by a specific physiological state of the organism or cell (i.e., by the differentiation state or in replicating or quiescent cells) or by exogenously-added factors, for example.

As a consequence of the infection of the producer cell with a helper virus, or transfection of the producer cell with an accessory function vector construct, accessory functions are expressed which transactivate the AAV packaging construct to produce AAV Rep and/or Cap proteins. The Rep expression products direct excision of the recombinant DNA (including the DNA of interest) from the AAV vector construct. The Rep proteins also serve to replicate the AAV genome. The expressed Cap proteins assemble into capsids, and the recombinant AAV genome is packaged into the capsids. Thus, productive AAV replication ensues, and the DNA is packaged into rAAV virions.

Following recombinant AAV replication, rAAV virions can be purified from the producer cell using a variety of conventional purification methods, such as $CsCl_2$ gradients or column purification. Further, if helper virus infection is employed to express the accessory functions, residual helper virus can be inactivated, using known methods. For example, adenovirus can be inactivated by heating to temperatures of approximately 60° C. for, e.g., 20 minutes or more. This treatment selectively inactivates the helper virus which is heat labile, while preserving the rAAV which is heat stable. The resulting rAAV virions are then ready for use for DNA delivery to a variety of target cells.

(f) In vivo Delivery Of rAAV Virions and Pharmaceutical Composition

The present invention relates to a method for the transfer of nucleic acid compositions to the cells of an individual. The method comprises the step of contacting cells of said individual with rAAV vectors which include said nucleic acid compositions, thereby delivering said nucleic acid compositions to the nucleus within said cells. The rAAV vectors are administered to the cells of said individual on an in vivo basis, i.e., the contact with the cells of the individual takes place within the body of the individual in accordance with the procedures which are most typically employed.

The rAAV vector is preferably suspended in a pharmaceutically acceptable delivery vehicle (i.e., physiologically compatible carrier), for administration to a human or non-human mammalian patient. Suitable carriers may be readily selected by one of skill in the art and may depend on the route of administration chosen. In the preferred embodiment, pharmaceutical compositions will comprise sufficient genetic material to produce a therapeutically effective amount of ABCA4.

The pharmaceutical compositions will also contain a pharmaceutically acceptable excipient. Such excipients include any pharmaceutical agent that does not itself induce an immune response harmful to the individual receiving the composition, and which may be administered without undue toxicity. Pharmaceutically acceptable excipients include, but are not limited to, liquids such as water, saline, glycerol and ethanol. Pharmaceutically acceptable salts can be included therein, for example, mineral acid salts such as hydrochlorides, hydrobromides, phosphates, sulfates, and the like; and the salts of organic acids such as acetates, propionates, malonates, benzoates, and the like. Additionally, auxiliary substances, such as wetting or emulsifying agents, pH buffering substances, and the like, may be present in such vehicles. Other exemplary carriers include lactose, sucrose, calcium phosphate, gelatin, dextran, agar, pectin, peanut oil, sesame oil, and water. The selection of the carrier is not a limitation of the present invention. Optionally, the compositions of the invention may contain, in addition to rAAV vector and carrier(s), other conventional pharmaceutical ingredients, such as preservatives, or chemical stabilizers. Suitable exemplary ingredients include microcrystalline cellulose, carboxymethylcellulose sodium, polysorbate 80, phenylethyl alcohol, chlorobutanol, potassium sorbate, sorbic acid, sulfur dioxide, propyl gallate, the parabens, ethyl vanillin, glycerin, phenol, parachlorophenol, gelatin and albumin. A thorough discussion of pharmaceutically acceptable excipients is available in REMINGTON'S PHARMACEUTICAL SCIENCES (Mack Pub. Co., N.J. 1991).

Appropriate doses will depend, among other factors, on the specifics of the AAV vector serotype chosen, on the route of administration (subretinal vs. intravitreal), on the mammal being treated (e.g., human or non-human primate or other mammal), age, weight, sex, and general condition of the subject to be treated and the mode of administration. Thus, the appropriate dosage may vary from patient to patient. An appropriate effective amount can be readily determined by one of skill in the art. In one specific embodiment, the rAAV vector is an AAV2/5 hybrid vector. A therapeutically effective human dosage for in vivo delivery of said vector by subretinal injection according to the present invention is believed to be in the range of from about 0.2 to about 1 ml of saline solution containing concentrations of from about $10^{10}$ to $10^{14}$ genomic vector particles/ml solution. The dosage will be adjusted to balance the therapeutic benefit against any side effects. In yet another embodiment, the pharmaceutically effective dose of the rAAV is generally in the range of concentrations of from about $10^5$ to $10^{50}$ genomes of rAAV, about $10^8$ to $10^{20}$ genomes of rAAV, about $10^{10}$ to about $10^{16}$ genomes of rAAV, or about $10^{11}$ to $10^{16}$ genomes of rAAV. A preferred human dosage may be about $10^{13}$ genomes of rAAV. Such concentrations may be delivered in about 0.001 ml to 100 ml, 0.05 to 50 ml, or 10 to 25 ml of a carrier solution. Other effective dosages can be readily established by one of ordinary skill in the art through routine trials establishing dose response curves.

Dosage treatment may be a single dose schedule or a multiple dose schedule. Moreover, the subject may be administered as many doses as appropriate. One of skill in the art can readily determine an appropriate number of doses.

However, the dosage may need to be adjusted to take into consideration an alternative route of administration, or balance the therapeutic benefit against any side effects. Such dosages may vary depending upon the therapeutic application for which the recombinant vector is employed. The levels of expression of the transgene can be monitored to determine the frequency of dosage of rAAV vectors, containing the minigene.

The vector particles are administered in sufficient amounts to enter the desired cells and to guarantee sufficient levels of functionality of the transferred nucleic acid composition to provide a therapeutic benefit without undue adverse, or with medically acceptable, physiological effects which can be determined by those skilled in the medical arts.

Optionally, in specific embodiments, rAAV-mediated delivery according to the invention may be combined with delivery by other viral and non-viral vectors. Such other viral vectors including, without limitation, adenoviral vectors, retroviral vectors, lentiviral vectors. herpes simplex virus (HSV) vectors, and baculovirus vectors may be readily selected and generated according to methods known in the art. Similarly, non-viral vectors, including, without limitation, liposomes, lipid-based vectors, polyplex vectors, molecular conjugates, polyamines and polycation vectors, may be readily selected and generated according to methods known in the art. When administered by these alternative routes, the dosage is desirable in the range described above.

(3) Embodiments (Examples)

The present invention can be put into practice in the form of several embodiments. Numerous modifications and variations can be made and still the result will come within the scope of the invention. No limitation with respect to the specific embodiments disclosed herein is intended or should be inferred.

In some embodiments, the recombinant AAV vector comprises a recombinant AAV genome with AAV2-ITRs, and the capsid is from AAV5. In other embodiments, the recombinant AAV vector comprises a recombinant AAV genome with AAV2-ITRs, and the capsid is from AAV7. In yet other embodiments, the recombinant AAV vector comprises a recombinant AAV genome with AAV5-ITRs, and the capsid is from AAV5. In yet other embodiments, the recombinant AAV vector comprises a recombinant AAV genome with AAV5-ITRs, and the capsid is from AAV7.

In some embodiments, the recombinant AAV vector comprises a recombinant AAV genome with one AAV2-ITR and one AAV5-ITR, and the capsid is from AAV5. In other embodiments, the recombinant AAV vector comprises a recombinant AAV genome with one AAV2-ITR and one AAV5-ITR, and the capsid is from AAV7.I In some embodiments, the recombinant AAV vector comprises an ABCA4 expression casssette. In other embodiments, the recombinant AAV vector comprises a Factor VIII expression cassette. In yet other embodiments, the recombinant AAV vector comprises a B-deleted Factor VIII expression cassette. In yet other embodiments, the recombinant AAV vector comprises a minidystrophin expression cassette.

In yet other embodiments, the recombinant AAV vector comprises a CFTR expression cassette. In yet other embodiments, the recombinant AAV vector comprises a Usherin-2a expression cassette.

In some embodiments, the recombinant AAV vector is a self-complementary AAV vector. In some of those embodiments, the self-complementary AAV vector comprises a PDE-6b expression cassette.

In some embodiments, gene expression is driven by a non-tissue specific promoter such as the RSV promoter (referenced by SEQ ID NO: 13), CMV promoter (referenced by SEQ ID NO: 14), PGK promoter (referenced by SEQ ID NO: 16), chicken beta-actin promoter ((referenced by SEQ ID NO: 15). In other embodiments, gene expression is driven by a tissue-specific promoter such as the MCK promoter (referenced by SEQ ID NO: 63), the TBG promoter (referenced by SEQ ID NO: 11), the RPE65 promoter (referenced by SEQ ID NO: 60), the Rhodopsin promoter (referenced by SEQ ID NO: 61), the RhoK promoter (referenced by SEQ ID NO: 12).

In some embodiments, the recombinant AAV genome will comprise an intron between the promoter and the coding sequence to increase expression. In other embodiments, a post-transcriptional control element is included in the expression cassette between the end of the coding sequence and the polyadenylion signal. An example of such a post-transcriptional control element is the WPRE (U.S. Pat. No. 6,136,597). Elements with similar function can be incorporated in the recombinant AAV genome and would still fall within the scope of the present invention.

In some embodiments, the expression cassette comprises the polyadenylation signal of the late SV40 T antigen. In other embodiments, the expression cassette comprises the polyadenylation signal of the bovine growth hormone. In yet other embodiments, the expression cassette comprises a short artificial polyadenylation signal.

The type of polyadenylation signal as well as the type of the promoter should not limit the scope of the present invention.

In some embodiments, the recombinant AAV virions comprising an ABCA4 expression casssette will be administered in vivo to the eye of a mammalian subject by subretinal injection. In other embodiments, the recombinant AAV virions comprising an ABCA4 expression cassette will be administered in vivo to the eye of a mammalian subject by intravitreal injection.

In some embodiments, the recombinant AAV virions comprising a minidystrophin expression casssette will be administered in vivo to the muscle of a mammalian subject by intramuscular injection. In other embodiments, the recombinant AAV virions comprising a minidystrophin expression cassette will be administered in vivo to a mammalian subject by systemic vector administration.

In some embodiments, the recombinant AAV virions comprising a Factor VIII expression casssette will be administered in vivo to the muscle of a mammalian subject by intramuscular injection. In other embodiments, the recombinant AAV virions comprising a Factor VIII expression cassette will be administered in vivo to the muscle of a mammalian subject by systemic vector administration.

In some embodiments, the recombinant AAV virions comprising a B-deleted Factor VIII expression casssette will be administered in vivo to the muscle of a mammalian subject by intramuscular injection. In other embodiments, the recombinant AAV virions comprising a B-deleted Factor VIII expression cassette will be administered in vivo to the muscle of a mammalian subject by systemic vector administration.

In some embodiments, the recombinant AAV virions comprising a Factor VIII expression casssette will be administered in vivo to the liver of a mammalian subject by portal vein injection. In other embodiments, the recombinant AAV virions comprising a Factor VIII expression cassette will be administered in vivo to the liver of a mammalian subject by systemic vector administration.

In some embodiments, the recombinant AAV virions comprising a B-deleted Factor VIII expression casssette will be administered in vivo to the liver of a mammalian subject by portal vein injection. In other embodiments, the recombinant AAV virions comprising a B-deleted Factor VIII expression cassette will be administered in vivo to the liver of a mammalian subject by systemic vector administration.

In some embodiments, the recombinant AAV virions comprising a Factor VIII expression casssette will be administered in vivo to the lung of a mammalian subject by nasal instillation. In other embodiments, the recombinant AAV virions comprising a Factor VIII expression cassette will be administered in vivo to the lung of a mammalian subject by inhalation or via a bronchoscope.

In some embodiments, the recombinant AAV virions comprising a B-deleted Factor VIII expression casssette will be administered in vivo to the lung of a mammalian subject by nasal instillation. In other embodiments, the recombinant AAV virions comprising a B-deleted Factor VIII expression cassette will be administered in vivo to the lung of a mammalian subject by inhalation or via a bronchoscope.

In some embodiments, the recombinant AAV virions of the present invention comprise the same capsid and ITRs. In other embodiments, the recombinant AAV virions of the present invention can comprise capsids of different serotypes as well as different ITRs. In its preferred embodiment, the recombinant AAV virions comprise recombinant AAV genomes with AAV2-ITRs packaged into a capsid of AAV serotype 5.

Example for the Production of Recombinant AAV Virions According to the Present Invention:

The sequence of the "trans plasmid" pack 2/5 is disclosed in the present invention (referenced by SEQ ID NO: 17) as well as the sequence of the "trans plasmid" pack2/7 (referenced by SEQ ID NO: 18). The sequence of the "Ad helper plasmid", which functions as an accessory function vector construct, is disclosed in the present invention (referenced by SEQ ID NO: 23); this Ad helper plasmid is commercially available from Stratagene GmbH, Germany. 293 human embryonic kidney cells, which contain the Ad E1 gene, were used in producing recombinant AAV virions. Those cells can also be purchased from various sources, e.g., Stratagene GmbH, Germany or Invitrogen GmbH, Germany. For the production of AAV5 virions, pack 2/5 was used in combination with AAV vectors harboring AAV2-ITRs; for the production of recombinant AAV7 virions, pack 2/7 was used in combination with AAV vectors harboring AAV2-ITRs.

The inventor used 150 mm tissue culture plates witch 20 ml of DMEM with 10% Fetal Calf Serum per plate. The night before the transfection, cells of confluent plates were split 1:2 in order to obtain 70% confluency the day of the transfection. Medium was changed in the morning of the transfection. Then, the inventor prepared 1.25 ml per plate of solution B (Solution B: 2× Hepes 0.2 μm filtered; for 1 liter: 16.4 g NaCl, 11.9 g Hepes, 0.21 g $Na_2HPO_4$, 800 ml $H_2O$, adjusted to pH 7.05 with 10N NaOH) in a 50 ml tube with a maximum of 12.5 ml for 10 plates in each tube. In another container, the inventor prepared solution A, comprising 0.125 ml/plate of 2.5M $CaCl_2$, 12.5 μg/plate of AAV vector genome plasmid ("cis plasmid"), 12.5 μg/plate of "trans plasmid" (harboring the AAV helper functions, i.e., pack 2/5 or pack 2/7) and 25 μg/plate of Ad helper plasmid (referenced by SEQ ID NO: 23). The sequences of potential cis plasmids according to the present invention are referenced by SEQ ID NO: 24, SEQ ID NO: 26, SEQ ID NO: 28, SEQ ID NO: 30, SEQ ID NO: 36, SEQ ID NO: 38, SEQ ID NO: 40, SEQ ID NO: 43.

The inventor then adjusted to a final volume of 1.25 ml per plate (i.e., 12.5 ml for 10 plates) with $H_2O$. After that, the inventor placed the tube with solution B on a vortexer at medium velocity and added dropwise the corresponding volume of solution A, e.g., 12.5 ml of solution A to 12.5 ml of solution B for the transfection of 10 150 mm plates. After mixing the two solutions, the inventor incubated the mixture for approximately 25 minutes at room temperature. He then added 2.5 ml/plate of the cocktail to the plates containing the medium with serum. Medium was changed the day after, and cells were harvested 72 hours after transfection by scraping and pelleting the cells in one tube. The cells were then frozen at −80° C. prior to purification.

In this paragraph, volumes refer to 100 plates of transfected 293 cells. The following steps were performed to purify AAV:

(1) Resuspension of the cell pellet in 50 ml of filtered 50 mM Tris pH 7.5/1 mM $MgCl_2$ (alternatively, DMEM or Phosphate-Buffered Saline can be used);

(2) A total of three cycles of freezing at −80° C. and thawing at room temperature;

(3) Addition of 20,000 units of DNAse and 0.5 ml of RNAse (20 mg/ml) and incubation for 30 minutes at 37° C.;

(4) Addition of 2.5 ml of 10% DOC (deoxycholic acid) and incubation for 10 min at 37° C.;

(5) Addition of 0.454 g $CsCl_2$/ml, mixing and incubation on ice for at least 5 min;

(6) Preparation of $CsCl_2$ gradient: Preparation of two solutions (which one can store at room temperature): 1.4 density (548.3 mg/m $CsCl_2$) and 1.6 density (816.5 mg/ml $CsCl_2$); the volume expands by adding $H_2O$; thus, one should dissolve in 450 ml and adjust after dissolution to 500 ml.

(7) Pipetting of 9 ml of 1.4 $CsCl_2$ in 89×24 mm polyallomer non-clear Beckman tubes (#326823; 3 tubes for a 100 plate preparation, 2 for a 50 plate preparation). Addition of 9 ml 1.6 $CsCl_2$ by going with the tip of the pipette at the bottom of the tube and starting to release the 9 ml very slowly (or 10 ml in pipette and discarding of 1 ml)—followed by the application of the sample to the top of the gradient (where the inventor went close to the surface to pipet). The entire sample was applied to the tubes and the tubes were then quilibrated (two decimals after the "dot").

(8) First spin in SW32 rotor (6 buckets) at 25,000 RPM at 4° C. for more than 18 hours.

(9) Preparation in a rack of 18 1.5 ml Eppendorf tubes; the polyallomer tube was put on a support. Then a 16 gauge needle was placed in the center of the bottom (where the rounding becomes flat), and the bottom was pierced letting the needle inside the polyallomer for 3 to 4 mm. The inventor then collected the first 5 ml in a 15 ml tube and then 1.5 ml fractions and read the refractive index by using a 6 μl sample of each fraction. Fractions within the range of (refractive index) 1.3730-1.3680 were collected and pooled for the second spin. (Towards the end of the collection, the inventor had to apply pressure by hand to make the solution run out of the tube; the first ml's flew extremely fast).

(10) The inventor then loaded 9 ml of the pooled fractions into one tube (2 tubes in total for a 50 plate prep; #361623) and equilibrated the tubes with 1.4 $CsCl_2$ solution.

(11) The inventor then loaded a TI 70.1 rotor and spun at 60,000 RPM at 4° C. for at least 18 hours. He then prepared a rack with 20 1.5 ml tubes. He placed the tube (3 at this time from a 100 plates prep) on a support and made a hole in the tube (as before) using a 16 gauge needle. He then fractioned 0.5 ml per 1.5 ml tube.

(12) The inventor then read each fraction density (range of refractive index for AAV: 1.3730-1.3680, density 1.391-1.450) by using a 6 μl sample of each fraction.

(13) The inventor pooled the "good" fractions in a Millipore 15 ml ultra-free tube and added 15 ml of TMN buffer (Tris 20 mM, pH 7.5+$MgCl_2$ 1 mM+NaCl 150 mM). He then spun it in a 50 ml tube for 30 min as 10° C. at 3,000 RPM. After the spin, he discarded the liquid in the bottom of the tube and repeated the procedure 4 times (to concentrate the virus). The inventor concentrated the virus to a final volume of 1 ml. Alternatively, one can perform dialysis in case one loses virus in the concentration step (and should use an 18-gauge needle for dialysis cassette).

The inventor then determined the genomic titer via Quantitative Real-Time PCR using the QuantiTect SYBR Green PCR Kit (Qiagen GmbH, Germany) according to the manufacturer's instructions.

Example 1

Efficient Packaging of Recombinant AAV Genomes Larger Than 5.7 kb, 6 kb, 6.5 kb, 7 kb, 7.5 kb, or 8 kb into AAV Capsids (i) Quantitative Real-time PCR In order to determine the effective packaging capacity of different AAV serotypes, the inventor produced AAV vectors with different serotypes and different genome sizes according to the methods disclosed in the present invention and published in prior art. The inventor then determined the genomic titer via Quantitative Real-Time PCR using the QuantiTect SYBR Green PCR Kit (Qiagen GmbH, Germany) according to the manufacturer's instructions. Prior to the Real-Time PCR, 25 µl of each recombinant vector preparation (in a final volume of 50 µl) was pretreated with 10 units of Deoxyribunuclease I (DNase; Fermentas GmbH, Germany) and 5 µg of Ribonuclease A (RNase; Fermentas GmbH, Germany) for 1 hour at 37° C. The DNase and RNase were then heat-inactivated for 30 minutes at 65° C. After that, the recombinant vector preparations were treated with 50 µg of Proteinase K (Fermentas GmbH, Germany) at 55° C. for 30 minutes and 60° C. for 30 minutes, and the Proteinase K was subsequently heat-inactivated for 20 minutes at 95° C.

For purposes of the quantitative Real-Time PCR, the inventor used two different volumes of pre-treated virus preparation, 5 µl of pretreated recombinant virus preparation and 1 µl of pretreated virus preparation. For AAV genomes harboring a Bovine Growth Hormone polyadenylation signal, the following primers at a concentration of 0.3 µM were used for the Real-Time PCR: QBGH+ (forward primer; referenced by SEQ ID NO: 52) and QBGH− (reverse primer; referenced by SEQ ID NO: 53). For AAV genomes harboring an SV40 polyadenylation signal, the following primers at a concentration of 0.3 µM were used for the Real-Time PCR: QSV40+ (forward primer; referenced by SEQ ID NO: 50) and QSV40− (reverse primer; referenced by SEQ ID NO: 51). PCR was performed in a final volume of 25 µl under the following conditions: 1 cycle of 95° C. for 13.5 minutes; 40 cycles of (a) 94° C. for 15 seconds (denaturation) and (b) 53° C. for 30 seconds (annealing) and (c) 72° C. for 30 seconds (elongation and data recording). The plasmid AAV luc-eGFP (referenced by SEQ ID NO: 40) was used in serial dilution as standard for vectors harboring the Bovine Growth Hormone polyadenylation signal and/or the SV40 polyadenylation signal. All experiments were performed in sample triplicates on a Bio-Rad iCycler iQ Real-Time PCR Detection System.

The results are summarized below as percentage of the results obtained with AAV luc-eGFP (full-length genome (with the following recombinant genome sizes: ~3.6 kb for AAV luc, ~4.9 kb for AAV luc-eGFP, ~6.6 kb for AAV minidystrophin, ~6.9 kb for AAV luc-eGFP stuffer, ~7.8 kb for AAV ABCA4, ~5.7 kb for AAV Factor VIII ΔB, ~7.9 kb for AAV Factor VIII v2, ~8.0 kb for AAV Factor VIII):

TABLE 1

Genomic titers as percentage of the genomic titer of AAV luc-eGFP; Y-axis: AAV vector; X-Axis: AAV capsid used for packaging:

| Vector | AAV1 | AAV2 | AAV4 | AAV5 | AAV7 | AAV8 | BAAV |
|---|---|---|---|---|---|---|---|
| AAV luc | 67% | 43% | 95% | 33% | 37% | 48% | 95% |
| AAV luc-eGFP | 100% | 100% | 100% | 100% | 100% | 100% | 100% |
| AAV minidystrophin | 12% | 1% | 1% | 28% | 16% | 11% | 4% |
| AAV luc-eGFP stuffer | 11% | 1% | 1% | 67% | 39% | 10% | 8% |
| AAV ABCA4 | 3% | 0% | 0% | 17% | 8% | 2% | 0% |
| AAV Factor VIII ΔB | 18% | 1% | 1% | 79% | 33% | 14% | 9% |
| AAV Factor VIII v2 | 1% | 0% | 0% | 14% | 4% | 0% | 0% |
| AAV Factor VIII | 1% | 0% | 0% | 11% | 4% | 0% | 0% |

TABLE 2

Genomic particles produced per producer cell: Y-axis: AAV vector; X-Axis: AAV capsid used for packaging:

| Vector | AAV1 | AAV2 | AAV4 | AAV5 | AAV7 | AAV8 | BAAV |
|---|---|---|---|---|---|---|---|
| AAV luc | 4,375 | 1,664 | 1,178 | 1,657 | 1,802 | 2,266 | 4,019 |
| AAV luc-eGFP | 6,530 | 3,870 | 1,240 | 5,020 | 4,870 | 4,720 | 4,230 |
| AAV minidystrophin | 784 | 39 | 12 | 1,406 | 779 | 519 | 169 |
| AAV luc-eGFP stuffer | 718 | 39 | 12 | 3,363 | 1,899 | 472 | 338 |
| AAV ABCA4 | 196 | — | — | 853 | 390 | 94 | — |
| AAV Factor VIII ΔB | 1,175 | 39 | 12 | 3,966 | 1,607 | 661 | 381 |

TABLE 2-continued

Genomic particles produced per producer cell: Y-axis: AAV vector; X-Axis: AAV capsid used for packaging:

| Vector | AAV1 | AAV2 | AAV4 | AAV5 | AAV7 | AAV8 | BAAV |
|---|---|---|---|---|---|---|---|
| AAV Factor VIII v2 | 65 | — | — | 703 | 195 | — | — |
| AAV Factor VIII | 65 | — | — | 552 | 195 | — | — |

TABLE 3

Genomic particles produced per cm² of growth area for adherent producer cells: Y-axis: AAV vector; X-Axis: AAV capsid used for packaging; data in $10^8$ genomic particles:

| Vector | AAV1 | AAV2 | AAV4 | AAV5 | AAV7 | AAV8 | BAAV |
|---|---|---|---|---|---|---|---|
| AAV luc | 9.96 | 3.79 | 2.68 | 3.77 | 4.10 | 5.16 | 9.15 |
| AAV luc-eGFP | 14.87 | 8.81 | 2.82 | 11.43 | 11.09 | 10.75 | 9.63 |
| AAV minidystrophin | 1.78 | 0.09 | 0.03 | 3.20 | 1.77 | 1.18 | 0.39 |
| AAV luc-eGFP stuffer | 1.64 | 0.09 | 0.03 | 7.66 | 4.32 | 1.07 | 0.77 |
| AAV ABCA4 | 0.45 | — | — | 1.94 | 0.89 | 0.21 | — |
| AAV Factor VIII ΔB | 2.68 | 0.09 | 0.03 | 9.03 | 3.66 | 1.50 | 0.87 |
| AAV Factor VIII v2 | 0.15 | — | — | 1.60 | 0.44 | — | — |
| AAV Factor VIII | 0.15 | — | — | 1.26 | 0.44 | — | — |

As one can see, efficient packaging of recombinant AAV genomes larger than 5.7 kb, larger than 6 kb, larger than 6.5 kb, larger than 7 kb, larger than 7.5 kb and larger than 8 kb is feasible into capsids of AAV serotype 5, i.e., more than 500 genomic particles are produced per producer cell, or more than $1.25 \times 10^8$ genomic particles are produced per cm² of growth area. Similarly, efficient packaging of recombinant AAV genomes larger than 5.7 kb, larger than 6 kb, larger than 6.9 kb is feasible into capsids of AAV serotypes 1, 5 and 7.

(ii) Long-Range PCR

In order to verify that the complete recombinant AAV genome is packaged into the AAV capsid, the inventor performed a long-range PCR on isolated AAV virions of AAV serotype 5, produced (a) with the cis plasmid referenced by SEQ ID NO: 24 (AAV ABCA4; recombinant AAV genome of ~7.8 kb), and (b) with the cis plasmid referenced by SEQ ID NO: 26 (AAV minidystrophin; recombinant AAV genome of ~6.6 kb), and (c) produced with the cis plasmid referenced by SEQ ID NO: 28 (RSV Factor VIII; recombinant AAV genome of ~8.0 kb).

Prior to the Long-Range PCR, 25 µl of each recombinant vector preparation (in a final volume of 50 µl) was pretreated with 10 units of Deoxyribunuclease I (DNase; Fermentas GmbH, Germany) and 5 µg of Ribonuclease A (RNase; Fermentas GmbH, Germany) for 1 hour at 37° C. The DNase and RNase were then heat-inactivated for 30 minutes at 65° C. After that, the recombinant vector preparations were treated with 50 µg of Proteinase K (Fermentas GmbH, Germany) at 55° C. for 30 minutes and 60° C. for 30 minutes, and the Proteinase K was subsequently heat-inactivated for 20 minutes at 95° C.

PCR was performed using primers RSV+ (forward primer; referenced by SEQ ID NO: 46) and SV40− (reverse primer; referenced by SEQ ID NO: 47) with the Expand Long Template PCR System (Roche Diagnostics; Germany) according to manufacturer's instructions with an annealing temperature of 55° C. using a Biometra T personal Thermocycler. The PCR products were separated using a 0.8% TAE gel and the GeneRuler DNA Ladder Mix (Fermentas GmbH, Germany).

As expected, a PCR product of approximately 7.3 kb (between the 6 kb and 8 kb band of the GeneRuler DNA Ladder Mix) could be detected using the recombinant AAV ABCA4 virions of AAV capsid serotype 5 as template, and a PCR product of approximately 6.1 kb (slightly above the 6 kb band of the GeneRuler DNA Ladder Mix) could be detected using the recombinant AAV minidystrophin virions of AAV capsid serotype 5 as template, and a PCR product of approximately 7.6 kb (close to the 8 kb band of the GeneRuler DNA Ladder Mix) could be detected using the recombinant AAV Factor VIII virions of AAV capsid serotype 5 as template.

Example 2

Efficient Gene Transfer into Mammalian Cells and Gene Expression in Mammalian Cells by AAV-mediated Gene Transfer of AAV Genomes Larger than 5.7 kb In order to prove efficient gene transfer into mammalian cells and gene expression in mammalian cells by AAV-mediated gene transfer of AAV genomes larger than 5.7 kb, the inventor produced recombinant AAV genomes packaged into capsids of AAV serotypes 1, 2, 5 and 7 according to the methods disclosed in the present invention and published in prior art—using the cis plasmid referenced by SEQ ID NO: 38 (AAV luc), the cis plasmid referenced by SEQ ID NO: 40 (AAV luc-eGFP), and the cis plasmid referenced by SEQ ID NO: 43 (AAV luc-eGFP stuffer). For that purpose, the inventor transfected subconfluent 293 cells in a 6-well plate (two wells per vector) with 4 µg of DNA (1 µg of trans plasmid, 1 1 µg of cis plasmid, 2 µg of Ad helper plasmid) using 6 µl FuGene 6 transfection reagent (Roche Diagnostics, Germany) according to the manufacturer's instructions. 3 days post transfection, cells were harvested in 500 µl of DMEM, and three rounds of freeze and thaw were performed. After that, the supernatant was transferred into a new 1.5 ml Eppendruf tube. Then, subconfluent 293 cells in a 96-well plate (100 µl medium per well) were transduced in triplicates with 10 µl virus lysate of AAV2/1 luc (AAV2-ITRs; AAV1 capsid), AAV 2/1 luc-eGFP (AAV2-ITRs; AAV1 capsid), AAV 2/1 luc-eGFP stuffer (AAV2-ITRs; AAV1 capsid), AAV2/2 luc (AAV2-ITRs; AAV2 capsid), AAV 2/2 luc-eGFP (AAV2-ITRs; AAV2 capsid), AAV 2/2 luc-eGFP stuffer (AAV2-ITRs; AAV2 capsid), AAV2/5 luc (AAV2-ITRs; AAV5 capsid), AAV 2/5 luc-eGFP (AAV2-ITRs; AAV5 capsid), AAV 2/5 luc-eGFP stuffer (AAV2-ITRs; AAV5 capsid), AAV2/7 luc (AAV2-ITRs; AAV7 capsid), AAV 2/7 luc-eGFP (AAV2-ITRs; AAV7 capsid), AAV 2/7 luc-eGFP stuffer (AAV2-ITRs; AAV7 capsid). Three days after transduction, green cells could be detected using an inverted fluorescence microscope in the wells transduced with AAV2/5 luc-eGFP, AAV2/5 luc-eGFP-stuffer, AAV2/7 luc-eGFP, and AAV2/7 luc-eGFP-stuffer—indicating successful transduction of mammalian cells and eGFP gene expression in mammalian cells. No eGFP expression could be detected in the wells transduced with AAV genomes packaged into capsids of AAV serotype 2.

Subsequently, cells were washed three times with Phosphate Buffered Saline (PBS), resuspended in 100 µl of PBS, and three cycles of freeze-and-thaw were performed in order to set free the cellular content including the luciferase protein. Luciferase activity was then quantified using the Luciferase Reporter Assay System (Promega GmbH, Germany) according to manufacturer's instructions and a Berthold LB 953 luminometer (EG & G Berthold GmbH; Germany). The results are depicted below (average value of the two virus lysates per vector and triplicate infection per vector lysate) as percentage of the luciferase activity of the infection with AAV luc-EGFP (full-length genome); Y-axis: AAV vector; X-Axis: AAV capsid used for packaging:

| Vector | AAV1 | AAV2 | AAV5 | AAV7 |
|---|---|---|---|---|
| AAV luc | 75% | 51% | 36% | 40% |
| AAV luc-eGFP | 100% | 100% | 100% | 100% |
| AAV luc-eGFP stuffer | 16% | <1% | 35% | 21% |

As one can see, efficient gene transfer into mammalian cells and gene expression in mammalian cells by AAV-mediated gene transfer of AAV genomes larger than 6 kb can be achieved using AAV genomes packaged into capsids of AAV serotype 5, AAV serotype 7 and AAV serotype 1, where AAV serotype 5 is superior to AAV serotype 7, and AAV serotype 7 is superior to AAV serotype 1. No significant gene expression can be detected at a genome size larger than 6 kb when the genomes are packaged into capsids of AAV serotype 2.

Example 3

Efficient Gene Transfer into Mammalian Cells in vivo and Gene Expression in Mammalian Cells in vivo by AAV-mediated Gene Transfer of AAV Genomes Larger than 5.7 kb In order to prove efficient gene transfer into mammalian cells in vivo and gene expression in mammalian cells in vivo by AAV-mediated gene transfer of AAV genomes larger than 5.7 kb, the inventor produced recombinant AAV vectors with capsids of AAV serotype 5, using the cis plasmid referenced by SEQ ID NO: 48 (AAV MCK lacZ) as disclosed in the present invention. The Adenovirus accessory function helper plasmid used in AAV production is referenced by SEQ ID NO: 23. The AAV2/5 trans plasmid, providing AAV2 Rep functions and AAV5 cap functions in AAV production, is referenced by SEQ ID NO: 17.

The right anterior tibialis muscles of four C57BL/6 mice were injected with $10^{10}$ genomic particles of AAV2/5 MCK lacZ (with a recombinant AAV genome size of ~5.9 kb). 60 days post injection, muscles were harvested and analyzed for lacZ expression by (a) histological staining including preparation of cryosections (2 mice) and (b) lacZ quantification (2 mice). LacZ expression and thus successful gene transfer in vivo and gene expression in vivo could be demonstrated by histological analysis (x-Gal staining): Blue cells could be detected in multiple sections. Furthermore, lacZ expression was quantified using a β-Galactosidase ELISA kit (Roche Diagnostics, Germany): 5.1 µg (mouse 1) and 5.8 βg of β-Galactosidase per gram of muscle protein could be detected. (No detectable β-Galactosidase expression could be detected in the left anterior tibialis muscles of the treated mice; the left anterior tibialis muscles were used as controls.)

Example 4

Expression of ABCA4 in Mammalian Cells by AAV-mediated Gene Transfer

In order to prove efficient gene transfer into mammalian cells and gene expression in mammalian cells by AAV-mediated gene transfer of AAV genomes harboring an ABCA4 expression cassette, the inventor produced recombinant AAV vector harboring an AAV genome comprising an ABCA4 expression cassette packaged into an AAV capsid of AAV serotype 5 (AAV2/5 ABCA4). The methods for producing AAV vectors are disclosed in the present invention and in prior art. The cis plasmid used to produce the AAV virion harboring the ABCA4 expression cassette is referenced by SEQ ID NO: 24. The Adenovirus accessory function helper plasmid used in AAV production is referenced by SEQ ID NO: 23. The AAV2/5 trans plasmid, providing AAV2 Rep functions and AAV5 cap functions in AAV production, is referenced by SEQ ID NO: 17.

$2 \times 10^5$ 293 cells were then transduced at a Multiplicity-of-Infection (MOI) of 1,000 with AAV2/5 ABCA4. As a control, $2 \times 10^5$ 293 cells were transduced at a Multiplicity-of-infection (MOI) of 1,000 with AAV2/5 minidystrophin. Three days after infection, cells were fixed and analyzed for ABCA4 gene expression using standard methods of immunohistochemistry and manufacturers' instructions with the antibody sc-21455 (ABCA4, N-20; Santa Cruz Biotechnology, Germany) as primary antibody, the antibody sc-2489 (a biotinylated mouse-anti-goat IgG antibody; Santa Cruz Biotechnology, Germany) as secondary antibody and Streptavidin-FITC (Sigma-Aldrich, Germany) as tertiary agent. Gene expression was then analyzed using a fluorescent light microscope. Whereas no ABCA4-positive cells could be detected in the sample transduced with AAV2/5 minidystrophin (as judged by FITC immunofluorescence), approximately 12% of 293 cells were fluorscent-positive for ABCA4 gene expression in the sample transduced with AAV2/5 ABCA4. (The amount of fluorescence was determined by counting the total amount of cells as well as the amount of fluorescent cells in five different views at a total magnification of 100).

In order to verify that the complete recombinant AAV genome has been transferred into the transduced cell, the inventor performed a long-range PCR on DNA isolated from transduced 293 cells. For that purpose, $10^6$ 293 cells were transduced at a Multiplicity-of-Infection (MOI) of 1,000 with AAV2/5 ABCA4. One day post transfection, medium was changed. Two days post transfection, cells were washed five times with Phosphate Buffered Saline (PBS) and then harvested in order to extract genomic DNA using the DNA Isolation Kit for Blood/Bone Marrow/Tissue (#12032805001; Roche Diagnostics, Germany) according to manufacturer's instructions. PCR was performed on isolated DNA using primers RSV+ (forward; referenced by SEQ ID NO: 46) and SV40– (reverse; referenced by SEQ ID NO: 47) with the Expand Long Template PCR System (Roche Diagnostics; Germany) according to manufacturer's instructions with an annealing temperature of 55° C. The PCR products were separated using a 0.8% TAE gel using the GeneRuler DNA Ladder Mix (Fermentas GmbH, Germany) as a marker. As expected, a PCR product of approximately 7.3 kb (between the 6 kb and 8 kb band of the GeneRuler DNA Ladder Mix) could be detected.

Example 5

In vivo Gene Transfer and Expression of ABCA4 in a Mammalian Subject by AAV-mediated Gene Transfer In order to prove efficient gene transfer into mammalian cells in vivo and gene expression in mammalian cells in vivo by AAV-mediated gene transfer of AAV genomes harboring an ABCA4 expression cassette, the artisan produces recombinant AAV vector harboring an AAV genome comprising an ABCA4 expression cassette packaged into an AAV capsid of AAV serotype 5 (AAV2/5 ABCA4). The methods for producing AAV vectors are disclosed in the present invention and in prior art. The cis plasmid to produce the AAV virion harboring the ABCA4 expression cassette is referenced by SEQ ID NO: 24. The Adenovirus accessory function helper plasmid for AAV production is referenced by SEQ ID NO: 23. The AAV2/5 trans plasmid, providing AAV2 Rep functions and AAV5 cap functions in AAV production, is referenced by SEQ ID NO: 17.

Then, the right anterior tibialis muscles of C57BL/6 mice are injected with $3\times10^{10}$ genomic particles of AAV2/5 ABCA4 (with a recombinant AAV genome size of ~7.8 kb). As a control, PBS is injected into the left anterior tibialis muscles. 80 days post injection, muscles are harvested, cryosections are prepared and then analyzed for ABCA4 expression by immunohistological staining using standard methods of immunohistochemistry kown to the artisan and published in prior art. The antibodies and reagents to be used are disclosed in "Example 4". Successful in vivo gene transfer as well as successful expression of ABCA4 in a mammalian subject can then be detected using a fluorescence microscope: Cells successfully transduced with AAV2/5 ABCA4 and expressing ABCA4 can be detected by fluorescence, non-transduced cells are not fluorescent. The control muscles do not show a fluorescence staining as there is no "natural" ABCA4 expression in muscle tissue. (ABCA4 is exclusively expressed in photoreceptor cells of the eye in wild-type, untreated C57BL/6 mice.)

Example 6

Expression of a Minidystrophin Gene in Mammalian Cells by AAV-mediated Gene Transfer In order to prove efficient gene transfer into mammalian cells and gene expression in mammalian cells by AAV-mediated gene transfer of AAV genomes harboring a minidystrophin expression cassette, the inventor produced recombinant AAV vector harboring an AAV genome comprising a minidystrophin expression cassette packaged into an AAV capsid of AAV serotype 5. The methods for producing AAV vectors are disclosed in the present invention and in prior art. The cis plasmid used to produce the AAV virion harboring the minidystrophin expression cassette is referenced by SEQ ID NO: 26. The Adenovirus accessory function helper plasmid used in AAV production is referenced by SEQ ID NO: 23. The AAV2/5 trans plasmid, providing AAV2 Rep functions and AAV5 cap functions in AAV production, is referenced by SEQ ID NO: 17.

$2\times10^5$ 293 cells were then transduced at a Multiplicity-of-Infection (MOI) of 1,000 with AAV2/5 minidystrophin. As a control, $2\times10^5$ 293 cells were transduced at a Multiplicity-of-Infection (MOI) of 1,000 with AAV2/5 ABCA4. Three days after infection, cells were fixed and analyzed for dystrophin gene expression using standard methods of immunohistochemistry and manufacturers' instructions with the antibody sc-7462 (dystrophin, v-20; Santa Cruz Biotechnology, Germany) as primary antibody, the antibody sc-2489 (a biotinylated mouse-anti-goat IgG antibody; Santa Cruz Biotechnology, Germany) as secondary antibody and Streptavidin-FITC (Sigma-Aldrich, Germany) as tertiary agent. Gene expression was then analyzed using a fluorescent light microscope. Whereas no dystrophin-positive cells could be detected in the sample transduced with AAV2/5 ABCA4 (as judged by FITC-immunofluorescence), approximately 17% of 293 cells were fluorscent-positive for dystrophin gene expression in the sample transduced with AAV2/5 dystrophin. (The amount of fluorescence was determined by counting the total amount of cells as well as the amount of fluorescent cells in five different views at a magnification of 100).

In order to verify that the complete recombinant AAV genome has been transferred into the transduced cell, the inventor performed a long-range PCR on DNA isolated from transduced 293 cells. For that purpose, $10^6$ 293 cells were transduced at a Multiplicity-of-Infection (MOI) of 1,000 with AAV2/5 minidystrophin. One day post transfection, medium was changed. Two days post transfection, cells were washed five times with Phosphate Buffered Saline (PBS) and then harvested in order to extract genomic DNA using the DNA Isolation Kit for Blood/Bone Marrow/Tissue (#12032805001; Roche Diagnostics, Germany) according to manufacturer's instructions. PCR was performed on isolated DNA using primers RSV+ (forward; referenced by SEQ ID NO: 46) and SV40– (reverse; referenced by SEQ ID NO: 47) with the Expand Long Template PCR System (Roche Diagnostics; Germany) according to manufacturer's instructions with an annealing temperature of 55° C. The PCR products were separated using a 0.8% TAE gel using the GeneRuler DNA Ladder Mix (Fermentas GmbH, Germany) as a marker. As expected, a PCR product of approximately 6.1 kb (shortly above the 6 kb band of the GeneRuler DNA Ladder Mix) could be detected.

Example 7

In vivo Gene Transfer and Expression of a Minidystrophin Gene in a Mammalian Subject by AAV-mediated Gene Transfer In order to prove efficient gene transfer into mammalian cells in vivo and gene expression in mammalian cells in vivo by AAV-mediated gene transfer of AAV genomes harboring a minidystrophin expression cassette, the artisan produces recombinant AAV vectors with capsids of AAV serotype 5 (AAV2/5 minidystrophin), using the cis plasmid referenced by SEQ ID NO: 26 (AAV minidystrophin) as disclosed in the present invention in general, and as disclosed in "Example 6". The Adenovirus accessory function helper plasmid for AAV production is referenced by SEQ ID NO: 23. The AAV2/5 trans plasmid, providing AAV2 Rep functions and AAV5 cap functions in AAV production, is referenced by SEQ ID NO: 17.

Then, the livers of C57BL/6 mice are injected via the portal vein with $3\times10^{10}$ genomic particles of AAV2/5 minidystrophin (with a recombinant AAV genome size of ~6.6 kb). As a control, PBS is injected into the portal vein of other C57BL/6 mice. 80 days post injection, the livers are harvested, cryosections are prepared and then analyzed for minidystrophin expression by immunohistological staining using standard methods of immunohistochemistry kown to the artisan and published in prior art. The antibodies and reagents to be used are disclosed in "Example 6". Successful in vivo gene transfer as well as successful expression of minidystrophin in a mammalian subject can then be detected using a fluorescence microscope: Cells successfully transduced with AAV2/5 minidystrophin and expressing minidystrophin can be detected by fluorescence, non-transduced cells are not fluorescent. The control livers do not show a fluorescence staining as there is no "natural" dystrophin expression in liver tissue. (Dystrophin is exclusively expressed in muscle cells of wild-type, untreated C57BL/6 mice.)

Example 8

Expression of Factor VIII and B-Domain Deleted Factor VIII in Mammalian Cells by AAV-mediated Gene Transfer In order to prove efficient gene transfer into mammalian cells and gene expression in mammalian cells by AAV-mediated gene transfer of AAV genomes harboring a Factor VIII expression cassette, the inventor produced recombinant AAV vector harboring an AAV genome comprising a Factor VIII expression cassette packaged into an AAV capsid of AAV serotype 5. The methods for producing AAV vectors are disclosed in the present invention and in prior art. The Adenovirus accessory function helper plasmid used in AAV production is referenced by SEQ ID NO: 23. The AAV2/5 trans plasmid, providing AAV2 Rep functions and AAV5 cap functions in AAV production, is referenced by SEQ ID NO: 17. The cis plasmids used to produce the AAV virions are referenced by SEQ ID NO: 28 for AAV Factor VIII (which comprises the RSV promoter) for the production of AAV virions vAAV2/5 Factor VIII;

SEQ ID NO: 30 for AAV B-deleted Factor VIII (which comprises the CMV promoter) for the production of AAV virions vAAV2/5 Factor VIII ΔB;

SEQ ID NO: 36 for AAV Factor VIII v2 (with a short, artificial polyadenylation signal) for the production of AAV virions vAAV2/5 Factor VIII v2.

Thus, a total of three different AAV preparations were made.

$10^6$ 293 cells were then transduced at a Multiplicity-of-Infection (MOI) of 1,000 with AAV2/5 Factor VIII, AAV2/5 Factor VIII ΔB and AAV2/5 Factor VIII v2, respectively. As a control, $10^6$ 293 cells were transduced at a Multiplicity-of-Infection (MOI) of 1,000 with AAV2/5 ABCA4. One day after infection, the medium was removed, and 1 ml of fresh medium added. Three days after infection, the supernatant was harvested and sterile filtered (0.8 μm filter). The Factor VIII concentration in the supernatant was then analyzed in triplicates using an ELISA kit (#F8C-EIA; Enzyme Research Laboratories Ltd., UK). The amount of Factor VIII was (average values) ~50 ng/ml (AAV2/5 Factor VIII), ~270 ng/ml (AAV2/5 Factor VIII ΔB) and ~55 ng/ml (AAV2/5 Factor VIII v2). No Factor VIII was detected in a control sample.

In order to verify that the complete recombinant AAV genome has been transferred into the transduced cell, the inventor performed a long-range PCR on DNA isolated from transduced 293 cells. For that purpose, $10^6$ 293 cells were transduced at a Multiplicity-of-Infection (MOI) of 1,000 with AAV2/5 Factor VIII and AAV2/5 Factor VIII ΔB, respectively. One day post transfection, medium was changed. Two days post transfection, cells were washed five times with Phosphate Buffered Saline (PBS) and then harvested in order to extract genomic DNA using the DNA Isolation Kit for Blood/Bone Marrow/Tissue (#12032805001; Roche Diagnostics, Germany) according to manufacturer's instructions.

PCR was performed on isolated DNA using the forward primer RSV+ (forward; referenced by SEQ ID NO: 46) for AAV2/5 Factor VIII and forward primer CMV+ (forward; referenced by SEQ ID NO: 62) for the AAV2/5 Factor VIII ΔB, and the reverse primer SV40– (reverse; referenced by SEQ ID NO: 47) for both vectors. PCR was performed using the Expand Long Template PCR System (Roche Diagnostics; Germany) according to manufacturer's instructions with an annealing temperature of 55° C. The PCR products were separated using a 0.8% TAE gel using the GeneRuler DNA Ladder Mix (Fermentas GmbH, Germany) as a marker. As expected, a PCR product of approximately 7.6 kb (shortly below the 8 kb band of the GeneRuler DNA Ladder Mix) could be detected in case of the Factor VIII vector AAV2/5 Factor VIII, and a PCR product of approximately 5.3 kb (between the 5 kb and 6 kb band of the GeneRuler DNA Ladder Mix) could be detected in case of the B-deleted Factor VIII vector, AAV2/5 Factor VIII ΔB.

Example 9

In vivo Gene Transfer and Expression of Factor VIII Coding Sequence and B-Deleted Factor VIII Coding Sequence in a Mammalian Subject by AAV-mediated Gene Transfer Transduction of Liver:

In order to prove efficient gene transfer into mammalian cells in vivo and gene expression in mammalian cells in vivo by AAV-mediated gene transfer of AAV genomes harboring a (B-deleted) Factor VIII expression cassette, the artisan produces recombinant AAV vectors with capsids of AAV serotype 5, using the cis plasmids referenced by SEQ ID NO: 28 for AAV2/5 Factor VIII SEQ ID NO: 30 for AAV2/5 Factor VIII ΔB (B-deleted Factor VIII)

SEQ ID NO: 36 for AAV Factor VIII v2 (with a short, artificial polyadenylation signal)

as disclosed in the present invention in general, and as disclosed in "Example 8".

Then, the livers of C57BL/6 mice are injected via the portal vein with $3\times10^{10}$ genomic particles of AAV2/5 Factor VIII, AAV2/5 Factor VIII ΔB, and AAV2/5 Factor VIII v2, respectively. As a control, PBS is injected into the portal vein of other C57BL/6 mice. 80 days post injection, serum is collected and then analyzed for Factor VIII expression and secretion using a Factor VIII ELISA (#F8C-EIA; Enzyme Research Laboratories Ltd., UK). Successful in vivo gene transfer as well as successful expression and secretion of Factor VIII (as well as B-domain deleted Factor VIII) is detected by detecting a statistically significant increase in Factor VIII circulation (p<0.05) in the AAV2/5 treated mice compared to the mice injected with PBS as a control.

Transduction of Muscle:

In order to prove efficient gene transfer into mammalian cells in vivo and gene expression in mammalian cells in vivo by AAV-mediated gene transfer of AAV genomes harboring a (B-deleted) Factor VIII expression cassette, the artisan produces recombinant AAV vectors with capsids of AAV serotype 5, using the cis plasmids referenced by SEQ ID NO: 28 for AAV2/5 Factor VIII
SEQ ID NO: 30 for AAV2/5 Factor VIII ΔB
SEQ ID NO: 36 for AAV2/5 Factor VIII v2 (with a short, artificial polyadenylation signal)

as disclosed in the present invention in general, and as disclosed in "Example 8".

Then, the anterior tibialis muscles of C57BL/6 mice are injected with $3 \times 10^{10}$ genomic particles of AAV2/5 Factor VIII, AAV2/5 Factor VIII ΔB, and AAV2/5 Factor VIII v2, respectively. As a control, PBS is injected into the anterior tibialis muscles of other C57BL/6 mice. 80 days post injection, serum is collected and then analyzed for Factor VIII expression and secretion using a Factor VIII ELISA (#F8C-EIA; Enzyme Research Laboratories Ltd., UK). Successful in vivo gene transfer as well as successful expression and secretion of Factor VIII is detected by detecting a statistically significant increase in Factor VIII circulation (p<0.05) in the AAV2/5 treated mice compared to the mice injected with PBS as a control.

Preferred Embodiment: Description of the Best Mode to Practice the Present Invention: Transduction of an ABCA4 Transgene Expression Casssette and Expression of ABCA4 in Mammalian Cells by AAV-Mediated Gene Transfer with AAV Capsids of AAV Serotype 5

Plasmid pAAV ABCA4 (referenced by SEQ ID NO: 24) was cloned as follows: Plasmid pAAV2.1lacZ (disclosed in U.S. patent application 20040052764) was digested with NotI and BamHI (Fermentas GmbH, Germany) and the resulting plasmid backbone (fragment L) was isolated. Similarly, plasmid pAAV5.1eGFP (disclosed in U.S. patent application 20040052764) was digested with NotI and BamHI, and the resulting eGFP fragment was isolated. Then, the eGFP fragment (NotI/BamHI) was inserted into plasmid backbone fragment L (NotI/BamHI), resulting in plasmid pAAV2.1eGFP. Plasmid pAAV2.1eGFP was then digested with NotI and BglII and the resulting ~1.3 kb fragment (fragment 2, harboring eGFP and WPRE) was isolated. Fragment 3 (RSV promoter) was generated by PCR with Pfu Polymerase (Fermentas GmbH, Germany) using RSV DNA as template with primers Clone/RSV+ (referenced by SEQ ID NO: 64) and Clone/RSV− (referenced by SEQ ID NO: 65) at 55° C. annealing temperature. Fragment 4 (SV40 late polyadenylation signal) was generated by PCR with Pfu Polymerase (Fermentas GmbH, Germany) using SV40 DNA as template with primers Clone/SV40+ (referenced by SEQ ID NO: 66) and Clone/SV40− (referenced by SEQ ID NO: 67) at 55° C. annealing temperature. Fragment 3 was digested with XbaI and NotI, fragment 4 was digested with BglII and SalI. Then, fragments 2, 3 and 4 were cloned in a multi-fragment ligation into the backbone fragment 1, resulting in the plasmid pAAV2.1 RSV eGFP WPRE SV40pA. Plasmid pAAV2.1 RSV eGFP WPRE SV40pA was then digested with BamHI and BglII (to remove the WPRE) and religated, yielding plasmid pAAV2.1 RSV eGFP SV40 pA (referenced by SEQ ID NO: 68). pAAV2.1 RSV eGFP SV40pA was then digested with NotI and HindIII and the plasmid backbone was isolated as fragment 5. In order to clone the ABCA4 cDNA, clone DKFZp686G1492Q2 (RZPD, Germany) was digested with KpnI and XbaI, and the corresponding 2,256 nucleotide fragment isolated (ABCA4 fragment 2). Then, PCR was performed using DKFZp686D1889Q2 (RZPD, Germany) as template with Pfu Polymerase (Fermentas GmbH, Germany) at 55° C. annealing temperature using primers ABCA4/NotI+ (referenced by SEQ ID NO: 54) and ABCA4/KpnI− (referenced by SEQ ID NO: 55). The PCR product was then digested with NotI and KpnI and is referred to as ABCA4 fragment 1. In parallel, PCR was performed using DKFZp686G1492Q2 (RZPD, Germany) as template with Pfu Polymerase (Fermentas GmbH, Germany) at 55° C. annealing temperature using primers ABCA4/XbaI+ (referenced by SEQ ID NO: 56) and ABCA4/HindIII− (referenced by SEQ ID NO: 57). The PCR product was then digested with NotI and KpnI and is referred to as ABCA4 fragment 3. Then, ABCA4 fragments 1, 2 and 3 were cloned in a multi-fragment ligation into backbone fragment 5, yielding the AAV cis plasmid pAAV ABCA4 (referenced by SEQ ID NO: 24). All PCRs were performed according to manufacturers' instructions unless noted otherwise.

In order to prove efficient gene transfer into mammalian cells and gene expression in mammalian cells by AAV-mediated gene transfer of AAV genomes harboring an ABCA4 expression cassette, the inventor produced recombinant AAV vector harboring an AAV genome comprising an ABCA4 expression cassette packaged into an AAV capsid of AAV serotype 5. The methods for producing AAV vectors are disclosed in the present invention and in prior art. The cis plasmid used to produce the AAV virion harboring the ABCA4 expression cassette is referenced by SEQ ID NO: 24. The Adenovirus accessory function helper plasmid used in AAV production is referenced by SEQ ID NO: 23. The AAV2/5 trans plasmid, providing AAV2 Rep functions and AAV5 cap functions in AAV production, is referenced by SEQ ID NO: 17. One method to produce the recombinant AAV virions of the preferred embodiment is disclosed in the present invention (see Example for the production of recombinant AAV virions according to the present invention.) Virus was produced according to that method using 50 15-cm tissue culture plates for transfection.

For the infection, $2 \times 10^5$ 293 cells were transduced at a Multiplicity-of-Infection (MOI) of 1,000 with AAV2/5 ABCA4. As a control, $2 \times 10^5$ 293 cells were transduced at a Multiplicity-of-Infection (MOI) of 1,000 with AAV2/5 minidystrophin. Three days after infection, cells were fixed and analyzed for ABCA4 gene expression using standard methods of immunohistochemistry and manufacturers' instructions with the antibody sc-21455 (ABCA4, N-20; Santa Cruz Biotechnology, Germany) as primary antibody, the antibody sc-2489 (a biotinylated mouse-anti-goat IgG antibody; Santa Cruz Biotechnology, Germany) as secondary antibody and Streptavidin-FITC (Sigma-Aldrich, Germany) as tertiary agent. Gene expression was then analyzed using a fluorescent light microscope. Whereas no ABCA4-positive cells could be detected in the sample transduced with AAV2/5 minidystrophin (as judged by FITC-immunofluorescence), approximately 12% of 293 cells were fluorscent-positive for ABCA4 gene expression in the sample transduced with AAV2/5 ABCA4. (The amount of fluorescence was determined by counting the total amount of cells as well as the amount of fluorescent cells in five different views at a total magnification of 100).

In order to verify that the complete recombinant AAV genome has been transferred into the transduced cell, the inventor performed a long-range PCR on DNA isolated from transduced 293 cells. For that purpose, $10^6$ 293 cells were transduced at a Multiplicity-of-Infection (MOI) of 1,000 with AAV2/5 ABCA4. One day post transfection, medium was changed. Two days post transfection, cells were washed five times with Phosphate Buffered Saline (PBS) and then harvested in order to extract genomic DNA using the DNA Isolation Kit for Blood/Bone Marrow/Tissue (#12032805001; Roche Diagnostics, Germany) according to manufacturer's instructions. PCR was performed on isolated DNA using primers RSV+ (forward; referenced by SEQ ID NO: 46) and SV40− (reverse; referenced by SEQ ID NO: 47) with the Expand Long Template PCR System (Roche Diagnostics; Germany) according to manufacturer's instructions with an annealing temperature of 55° C. The PCR products were separated using a 0.8% TAE gel using the GeneRuler DNA Ladder Mix (Fermentas GmbH, Germany) as a marker. As expected, a PCR product of approximately 7.3 kb (between the 6 kb and 8 kb band of the GeneRuler DNA Ladder Mix) could be detected. No such band could be detected in a control PCR performed on DNA isolated from untransduced 293 cells.

SEQUENCE LISTING (69 sequences)

SEQ ID NO: 1 - DNA, 6822 bp, Homo sapiens
  CDS (1)..(6822): ABCA4 coding sequence
atgggcttcgtgagacagatacagcttttgctctggaagaactggaccctgcggaaaaggcaaaagattcgctttgtggtggaactcgtgtggcctttatctttatttctggtcttgatctggttaaggaatgccaacccactctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactcagtggtctaccttctgatcaactctcaagtccgtccagagcagttcgctcatggagtcccggacctggcgctgaaggacatcgcctgcagcgaggccctcctggagcgcttcatcatcttcagccagagacgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggtatcaatctgagatcttggggaggaatattatctgatatgtcaccaagaattcaagagtttatccatcggccgagtatgcaggacttgctgtgggtgaccaggcccctcatgcagaatggtggtccagagacctttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgcagcacgaaggatactgaagaatgccaactcaacttttgaagaactggaacacgttaggaagttggtcaaagcctgggaagaagtagggccccagatctggtacttctttgacaacagcacacagatgaacatgatcagagataccctggggaacccaacagtaaaagactttttgaataggcagcttggtgaagaaggtattactgctgaagccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacaggtattgggattctggtcccagagctgatcccgtggaagatttccggtacatctggggcgggtttgcctatctgcaggacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagaccttgaaaaatcagggtgtctccaatgcagtgatttggtgtacctggttcctggacagcttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctctacctgccacacatcctgtgcttcgcctggcaggaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtctatggcttactcgcttggtaccttgatcaggtgtttccaggagactatggaaccccacttccttggtactttcttctacaagagtcgtattggcttggcggtgaagggtgttcaaccagagaagaaagagccctggaaaagaccgagcccctaacagaggaaacggaggatccagagcacccagaaggaatacacgactccttctttgaacgtgagcatccagggtgggttcctggggtatgcgtgaagaatctggtaaagatttttgagccctgtggccggccagctgtggaccgtctgaacatcaccttctacgagaaccagatcaccgcattcctgggccacaatggagctgggaaaaccaccaccttgtccatcctgacgggtctgttgccaccaacctctgggactgtgctcgttgggggaagggacattgaaaccagcctggatgcagtccggcagagccttggcatgtgtccacagcacaacatcctgttccaccacctcacggtggctgagcacatgctgttctatgcccagctgaaaggaaagtcccaggaggaggcccagctggagatggaagccatgttggaggacacaggcctccaccacaagcggaatgaagaggctcaggacctatcaggtggcatgcagagaaagctgtcggttgccattgcctttgtgggagatgccaaggtggtgattctggacgaacccacctctggggtggacccttactcgagacgctcaatctgggatctgctcctgaagtatcgctcaggcagaaccatcatcatgtccactcaccacatggacgaggccgacctccttggggaccgcattgccatcattgcccagggaaggctctactgctcaggcaccccactcttcctgaagaactgctttggcacaggcttgtacttaaccttggtgcgcaagatgaaaaacatccagagccaaaggaaaggcagtgaggggacctgcagctgctcgtctaagggtttctccaccacgtgtccagcccacgtcgatgacctaactccagaacaagtcctggatggggatgtaaatgagctgatggatgtagttctccaccatgttccagaggcaaagctggtggagtgcattggtcaagaacttatcttccttcttccaaataagaacttcaagcacagagcatatgccagccttttcagagagctggaggagacgctggctgaccttggtctcagcagttttggaatttctgacactcccctggaagagatttttctgaaggtcacggaggattctgattcaggacctctgtttgcgggtggcgctcagcagaaaagagaaaacgtcaacccccgacacccctgcttgggtcccagagagaaggctggacagacaccccaggactccaatgtctgctccccaggggcgccggctgctcacccagagggccagcctcccccagagccagagtgcccaggcccgcagctcaacacggggacacagctggtcctccagcatgtgcaggcgctgctggtcaagagattccaacacaccatccgcagccacaaggacttcctggcgcagatcgtgctcccggctacctttgtgtttttggctctgatgctttctattgttatccctccttttggcgaataccccgctttgacccttcacccctggatatatgggcagcagtacaccttcttcagcatggatgaaccaggcagtgagcagttcacggtacttgcagacgtcctcctgaataagccaggctttggcaaccgctgcctgaaggaagggtggcttccggagtacccctgtggcaactcaacaccctggaagactccttctgtgtccccaaacatcacccagctgttccagaagcagaaatggacacaggtcaacccttcaccatcctgcaggtgcagcaccagggagaagctcaccatgctgccagagtgccccgagggtgccgggggcctcccgcccccccagagaacacagcgcagcacggaaattctacaagacctgacggacaggaacatctccgacttcttggtaaaaacgtatcctgctcttataagaagcagcttaaagagcaaattctgggtcaatgaacagaggtatggaggaatttccattggaggaaagctcccagtcgtccccatcacgggggaagcacttgttgggtttttaagcgaccttggccggatcatgaatgtgagcgggggccctatcactagagaggcctctaaagaaatacctgatttccttaaacatctagaaactgaagacaacattaaggtgtggtttaataacaaaggctggcatgccctggtcagctttctcaatgtggcccacaacgccatcttacgggccagcctgcctaaggacaggagccccgaggagtatggaatcaccgtcattagccaacccctgaacctgaccaaggagcagctctcagagattacagtgctgaccacttcagtggatgctgtggttgccatctgcgtgattttctccatgtccttcgtcccagccagctttgtcctttatttgatccaggagcgggtgaacaaatccaagcacctccagtttatcagtggagtgagccccaccacctactgggtgaccaacttcctctgggacatcatgaattattccgtgagtgctgggctggtggtgggcatcttcatcgggtttcagaagaaagcctacacttctccagaaaaccttcctgcccttgtggcactgctcctgctgtatggatgggcggtcattcccatgatgtacccagcatccttcctgtttgatgtccccagcacagcctatgtggctttatcttgtgctaatctgttcatcggcatcaacagcagtgctattaccttcatcttggaattatttgagaataaccggacgctgctcaggttcaacgccgtgctgaggaagctgctcattgtcttcccccacttctgcctgggccggggcctcattgaccttgcactgagccaggctgtgacagatgtctatgcccggtttggtgaggagcactctgcaaatccgttccactgggacctgattgggaagaacctgtttgccatggtggtggaaggggtggtgtacttcctcctgaccctgctggtccagcgccacttcttcctctcccaatggattgccgagcccactaaggagcccattgttgatgaagatgatgatgtggctgaagaaagacaaagaattattactggtggaaataaaactgacatcttaaggctacatgaactaaccaagatttatccaggcacctccagcccagcagtggacaggctgtgtgtcggagttcgccctggagagtgctttggcctcctgggagtgaatggtgccggcaaaacaaccacattcaagatgctcactggggacaccacagtgacctcaggggatgccaccgtagcaggcaagagtattttaaccaatatttctgaagtccatcaaaatatgggctactgtcctcagtttgatgcaattgatgagctgctcacaggacgagaacatctttacctttatgcccggcttcgaggtgtaccagcagaagaaatcgaaaaggttgcaaactggagtattaagagcctgggcctgactgtctacgccgactgcctggctggcacgtacagtgggggcaacaagcggaaactctccacagccatcgcactcattggctgcccaccgctggtgctgctggatgagcccaccacagggatggacccccaggcacgccgcatgctgtggaacgtcatcgtgagcatcatcagagaagggagggctgtggtcctcacatcccacagcatggaagaatgtgaggcactgtgtacccggctggccatcatggtaaagggcgcctttcgatgtatgggcaccattcagcatctcaagtccaaatttggagatggctatatcgtcacaatgaagatcaaatccccgaaggacgacctgcttcctgacctgaaccctgtggagcagttcttccaggggaacttcccaggcagtgtgcagagggagaggcactacaacatgctccagttccaggtctcctcctcctccctggcgaggatcttccagctcctcctctcccacaaggacagcctgctcatcgaggagtactcagtcacacagaccacactggaccaggtgtttgtaaattttgctaaacagcagactgaaagtcatgacctccctctgcaccctcgagctgctggagccagtcgacaagcccaggactga

SEQ ID NO: 2 - protein, 2273 aa, Homo sapiens [sequence omitted]

SEQ ID NO: 3 - DNA, 7056 bp, Homo sapiens
  CDS (1)..(7056): Factor VIII coding sequence
atgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccgtagcactaggcaaaagcaatttaatgccaccacaattccagaaaatgacatagagaagactgacccttggtttgcacacagaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgacggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactga

SEQ ID NO: 4 - protein, 2351 aa, Homo sapiens [sequence omitted]

SEQ ID NO: 5 - DNA, 4428 bp, Artificial Sequence
  Human Factor VIII coding sequence with B-domain deletion
  CDS (1)..(4428): B-deleted Factor VIII coding sequence
atgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttcaagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactga

SEQ ID NO: 6 - protein, 1475 aa, Artificial Sequence
  Synthetic Construct
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 7 - DNA, 11058 bp, Homo sapiens
  CDS (1)..(11058): dystrophin coding sequence
atgctttggtgggaagaagtagaggactgttatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcaggtcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagctgcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagagagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtag

SEQ ID NO: 8 - protein, 3685 aa, Homo sapiens
MLWWEEVEDCYEREDVQKKTFTKWVNAQFSKFGKQHIENLFSDLQDGRRLLDLLEGLTGQKLPKEKGSTRVHALNNVNKALRVLQNNNVDLVNIGSTDIVDGNHKLTLGLIWNIILHWQVKNVMKNIMAGLQQTNSEKILLSWVRQSTRNYPQVNVINFTTSWSDGLALNALIHSHRPDLFDWNSVVCQQSATQRLEHAFNIARYQLGIEKLLDPEDVDTTYPDKKSILMYITSLFQVLPQQVSIEAIQEVEMLPRPPKVTKEEHFQLHHQMHYSQQITVSLAQGYERTSSPKPRFKSYAYTQAAYVTTSDPTRSPFPSQHLEAPEDKSFGSSLMESEVNLDRYQTALEEVLSWLLSAEDTLQAQGEISNDVEVVKDQFHTHEGYMMDLTAHQGRVGNILQLGSKLIGTGKLSEDEETEVQEQMNLLNSRWECLRVASMEKQSNLHRVLMDLQNQKLKELNDWLTKTEERTRKMEEEPLGPDLEDLKRQVQQHKVLQEDLEQEQVRVNSLTHMVVVVDESSGDHATAALEEQLKVLGDRWANICRWTEDRWVLLQDILLKWQRLTEEQCLFSAWLSEKEDAVNKIHTTGFKDQNEMLSSLQKLAVLKADLEKKKQSMGKLYSLKQDLLSTLKNKSVTQKTEAWLDNFARCWDNLVQKLEKSTAQISQAVTTTQPSLTQTTVMETVTTVTTREQILVKHAQEELPPPPPQKKRQITVDSEIRKRLDVDITELHSWITRSEAVLQSPEFAIFRKEGNFSDLKEKVNAIEREKAEKFRKLQDASRSAQALVEQMVNEGVNADSIKQASEQLNSRWIEFCQLLSERLNWLEYQNNIIAFYNQLQQLEQMTTTAENWLKIQPTTPSEPTAIKSQLKICKDEVNRLSGLQPQIERLKIQSIALKEKGQGPMFLDADFVAFTNHFKQVFSDVQAREKELQTIFDTLPPMRYQETMSAIRTWVQQSETKLSIPQLSVTDYEIMEQRLGELQALQSSLQEQQSGLYYLSTTVKEMSKKAPSEISRKYQSEFEEIEGRWKKLSSQLVEHCQKLEEQMNKLRKIQNHIQTLKKWMAEVDVFLKEEWPALGDSEILKKQLKQCRLLVSDIQTIQPSLNSVNEGGQKIKNEAEPEFASRLETELKELNTQWDHMCQQVYARKEALKGGLEKTVSLQKDLSEMHEWMTQAEEEYLERDFEYKTPDELQKAVEEMKRAKEEAQQKEAKVKLLTESVNSVIAQAPPVAQEALKKELETLTTNYQWLCTRLNGKCKTLEEVWACWHELLSYLEKANKWLNEVEFKLKTTENIPGGAEEISEVLDSLENLMRHSEDNPNQIRILAQTLTDGGVMDELINEELETFNSRWRELHEEAVRRQKLLEQSIQSAQETEKSLHLIQESLTFIDKQLAAYIADKVDAAQMPQEAQKIQSDLTSHEISLEEMKKHNQGKEAAQRVLSQIDVAQKKLQDVSMKFRLFQKPANFELRLQESKMILDEVKMHLPALETKSVEQEVVQSQLNHCVNLYKSLSEVKSEVEMVIKTGRQIVQKKQTENPKELDERVTALKLHYNELGAKVTERKQQLEKCLKLSRKMRKEMNVLTEWLAATDMELTKRSAVEGMPSNLDSEVAWGKATQKEIEKQKVHLKSITEVGEALKTVLGKKETLVEDKLSLLNSNWIAVTSRAEEWLNLLLEYQKHMETFDQNVDHITKWIIQADTLLDESEKKKPQQKEDVLKRLKAELNDIRPKVDSTRDQAANLMANRGDHCRKLVEPQISELNHRFAAISHRIKTGKASIPLKELEQFNSDIQKLLEPLEAEIQQGVNLKEEDFNKDMNEDNEGTVKELLQRGDNLQQRITDERKREEIKIKQQLLQTKHNALKDLRSQRRKKALEISHQWYQYKRQADDLLKCLDDIEKKLASLPEPRDERKIKEIDRELQKKKEELNAVRRQAEGLSEDGAAMAVEPTQIQLSKRWREIESKFAQFRRLNFAQIHTVREETMMVMTEDMPLEISYVPSTYLTEITHVSQALLEVEQLLNAPDLCAKDFEDLFKQEESLKNIKDSLQQSSGRIDIIHSKKTAALQSATPVERVKLQEALSQLDFQWEKVNKMYKDRQGRFDRSVEKWRRFHYDIKIFNQWLTEAEQFLRKTQIPENWEHAKYKWYLKELQDGIGQRQTVVRTLNATGEEIIQQSSKTDASILQEKLGSLNLRWQEVCKQLSDRKKRLEEQKNILSEFQRDLNEFVLWLEEADNIASIPLEPGKEQQLKEKLEQVKLLVEELPLRQGILKQLNETGGPVLVSAPISPEEQDKLENKLKQTNLQWIKVSRALPEKQGEIEAQIKDLGQLEKKLEDLEEQLNHLLLWLSPIRNQLEIYNQPNQEGPFDVQETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLQELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 9 - DNA, 5592 bp, Artificial Sequence
  human minidystrophin coding sequence
  CDS (1)..(5592): minidystrophin coding sequence
atgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacaggttcaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtagtag

SEQ ID NO: 10 - protein, 1862 aa, Artificial Sequence
  Synthetic Construct
MKNIMAGLQQTNSEKILLSWVRQSTRNYPQVNVINFTTSWSDGLALNALIHSHRPDLFDWNSVVCQQSATQRLEHAFNIARYQLGIEKLLDPEDVDTTYPDKKSILMYITSLFQVLPQQVSIEAIQEVEMLPRPPKVTKEEHFQLHHQMHYSQQITVSLAQGYERTSSPKPRFKSYAYTQAAYVTTSDPTRSPFPSQHLEAPEDKSFGSSLMESEVNLDRYQTALEEVLSWLLSAEDTLQAQGEISNDVEVVKDQFHTHEGYMMDLTAHQGRVGNILQLGSKLIGTGKLSEDEETEVQEQMNLLNSRWECLRVASMEKQSNLHRVLMDLQNQKLKELNDWLTKTEERTRKMEEEPLGPDLEDLKRQVQQHKVLQEDLEQEQVRVNSLTHMVVVVDESSGDHATAALEEQLKVLGDRWANICRWTEDRWVLLQDILLKWQRLTEEQCLFSAWLSEKEDAVNKIHTTGFKDQNEMLSSLQKLAVLKADLEKKKQSMGKLYSLKQDLLSTLKNKSVTQKTEAWLDNFARCWDNLVQKLEKSTAQVQETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLQELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 11 - DNA, 709 bp, Homo sapiens
  promoter (1)..(709): TBG promoter
gctagcaggttaatttttaaaaagcagtcaaaagtccaagtggcccttggcagcatttactctctctgtttgctctggttaataatctcaggagcacaaacattccagatccaggttaatttttaaaaagcagtcaaaagtccaagtggcccttggcagcatttactctctctgtttgctctggttaataatctcaggagcacaaacattccagatccggcgcgccagggctggaagctacctttgacatcatttcctctgcgaatgcatgtataatttctacagaacctattagaaaggatcacccagcctctgcttttgtacaactttcccttaaaaaactgccaattccactgctgtttggcccaatagtgagaactttttcctgctgcctcttggtgcttttgcctatggcccctattctgcctgctgaagacactcttgccagcatggacttaaacccctccagctctgacaatcctctttctcttttgttttacatgaagggtctggcagccaaagcaatcactcaaagttcaaaccttatcattttttgctttgttcctcttggccttggttttgtacatcagctttgaaaataccatcccagggttaatgctggggttaatttataactaagagtgctctagttttgcaatacaggacatgctataaaaatggaaagatgttgctttctgagagactgcag

SEQ ID NO: 12 - DNA, 199 bp, Homo sapiens
  promoter (1)..(199): RhoK promoter
gggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttagcctggtgctgtgtcagccccggg

SEQ ID NO: 13 - DNA, 259 bp, Rous sarcoma virus
  promoter (1)..(259): RSV promoter
  promoter (1)..(259)
gctagcaatgtagtcttatgcaatactcttgcaacatgcttatgtaacgatgagttagcaacatgccttacaaggagagaaaaagcaccgtgcatgacgattggtggaagtaaggtggtacgatcgtgccttattaggaaggcaacagacgggtctgacatggattggacgaaccactgaattccgcattgcagagatattgtatttaagtgcctagctcgatacaataaacgccatttgaccattcaccacactgcag

SEQ ID NO: 14 - DNA, 601 bp, Artificial Sequence
  CMV immediate/ early enhancer promoter
  promoter (1)..(601)
gctagctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcctgcag

SEQ ID NO: 15 - DNA, 356 bp, Artificial Sequence
  chicken
  promoter (1)..(356)
  misc_feature (86)..(86): n is a, c, g, or t
  misc_feature (146)..(146): n is a, c, g, or t
  misc_feature (150)..(150): n is a, c, g, or t
  misc_feature (185)..(185): n is a, c, g, or t
  misc_feature (193)..(193): n is a, c, g, or t
  misc_feature (270)..(270): n is a, c, g, or t
gtcgacggtatcgataaagcttgtcgaggtgagccccacgttctgcttcactctccccatctcccccccctccccacccccaattntgtatttatttattttttaattattttgtgcagcgatgggggcggggggggggggggggngcgncgccgggcgaggggcggggcggggcgaggggcggngcggggcnaggcggaaaggtgcggcggcagccaatcagagcggcgcgctccgaaagtttccttttatggcgaggcggcggcggcnggcggccctataaaaagcgaagcgcgcggcgggcgggagatcgaattcctgcagcccgggggatccactagttctagagcggccgc

SEQ ID NO: 16 - DNA, 526 bp, Mus musculus
  promoter (1)..(526): PGK promoter
gctagcaattctaccgggtaggggaggcgcttttcccaaggcagtctggagcatgcgctttagcagccccgctggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctcgcacgcttcaaaagcgcacgtctgccgcgctgttctcctcttcctcatctccgggcctttctgcagcggccgc

SEQ ID NO: 17 - DNA, 7978 bp, Artificial Sequence
  AAV2/5 packaging construct; AAV5 capsid; replicates AAV genomes with AAV2 ITR
  misc_feature (1)..(7978): AAV2/5 packaging construct; pack 2/5
tctagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccccgagtccttcaatgctatcattccctttgatattggaccatatgcatagtaccgagaaactagtgcgaagtagtgatcaggtattgctgttagatatccccgagtccttcaatgctatcattctctttgatattggaccatatgcatagtaccgagaaactagtgcgaagtagtgatcaggtattgctgttagatatccccgagtccttcaatgctatcattccctttgatattggaccatatgcatagtaccgagaaactagtgcgaagtagtgatcaggtattgctgttagatatccccgagtccttcaatgctatcattctctttgatattggaccatatgcatagtaccgagaaactagtgcgaagtagtgatcaggtattgctgttagatatccccgagtccttcaatgctatcattccctttgatattggaccatatgcatagtaccgagaaactagtgcgaagtagtgatcaggtattgctgttagatatccccgagtccttcaatgctatcatttcctttgatattggatcatatgcatagtaccgagaaactagtgcgaagtagtgatcaggtattgctgttaaggatccatcacactggcggccgctcgaggggagctcgcagggtctccattttgaagcgggaggtttgaacgcgcagccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggctcttttctttgtgcaatttgagaagggagagagctacttccacatgcacgtgctcgtggaaaccaccggggtgaaatccatggttttgggacgtttcctgagtcagattcgcgaaaaactgattcagagaatttaccagcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctgttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaattgcttgttaatcaataaaccgtttaattcgtttcagttgaactttggtctctgcgtatttctttcttatctagtttccatgctctagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatgatccactagtaacggccgccagtgtgctggaattcggctttgtagttaatgattaacccggcatgctacttatctacgtagccatgc

SEQ ID NO: 18 - DNA, 7332 bp, Artificial Sequence
  AAV packaging construct for AAV vectors with AAV2-ITRs to be packaged into AAV7 capsid
  misc_feature (1)..(7332): AAV2/7 packaging construct; pack 2/7
tcgaggacaacctctctgagggcattcgcgagtggtgggacctgaaacctggagccccgaaacccaaagccaaccagcaaaagcaggacaacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcatttgggggcaacctcgggcgagcagtcttccaggccaagaagcgggttctcgaacctctcggtctggttgaggaaggcgctaagacggctcctgcaaagaagagaccggtagagccgtcacctcagcgttcccccgactcctccacgggcatcggcaagaaaggccagcagcccgccagaaagagactcaatttcggtcagactggcgactcagagtcagtccccgaccctcaacctctcggagaacctccagcagcgccctctagtgtgggatctggtacagtggctgcaggcggtggcgcaccaatggcagacaataacgaaggtgccgacggagtgggtaatgcctcaggaaattggcattgcgattccacatggctgggcgacagagtcattaccaccagcacccgaacctgggccctgcccacctacaacaaccacctctacaagcaaatctccagtgaaactgcaggtagtaccaacgacaacacctacttcggctacagcaccccctgggggtattttgactttaacagattccactgccacttctcaccacgtgactggcagcgactcatcaacaacaactggggattccggcccaagaagctgcggttcaagctcttcaacatccaggtcaaggaggtcacgacgaatgacggcgttacgaccatcgctaataaccttaccagcacgattcaggtattctcggactcggaataccagctgccgtacgtcctcggctctgcgcaccagggctgcctgcctccgttcccggcggacgtcttcatgattcctcagtacggctacctgactctcaacaatggcagtcagtctgtgggacgttcctccttctactgcctggagtacttcccctctcagatgctgagaacgggcaacaactttgagttcagctacagcttcgaggacgtgcctttccacagcagctacgcacacagccagagcctggaccggctgatgaatcccctcatcgaccagtacttgtactacctggccagaacacagagtaacccaggaggcacagctggcaatcgggaactgcagttttaccagggcgggccttcaactatggccgaacaagccaagaattggttacctggaccttgcttccggcaacaaagagtctccaaaacgctggatcaaaacaacaacagcaactttgcttggactggtgccaccaaatatcacctgaacggcagaaactcgttggttaatcccggcgtcgccatggcaactcacaaggacgacgaggaccgctttttcccatccagcggagtcctgatttttggaaaaactggagcaactaacaaaactacattggaaaatgtgttaatgacaaatgaagaagaaattcgtcctactaatcctgtagccacggaagaatacgggatagtcagcagcaacttacaagcggctaatactgcagcccagacacaagttgtcaacaaccagggagccttacctggcatggtctggcagaaccgggacgtgtacctgcagggtcccatctgggccaagattcctcacacggatggcaactttcacccgtctcctttgatgggcggctttggacttaaacatccgcctcctcagatcctgatcaagaacactcccgttcccgctaatcctccggaggtgtttactcctgccaagtttgcttcgttcatcacacagtacagcaccggacaagtcagcgtggaaatcgagtgggagctgcagaaggaaaacagcaagcgctggaacccggagattcagtacacctccaactttgaaaagcagactggtgtggactttgccgttgacagccagggtgtttactctgagcctcgccctattggcactcgttacctcacccgtaatctgtaattgcatgttaatcaataaaccggttgattcgtttcagttgaactttggtctctgcgaagggcgaattcgtttaaacctgcaggactagagtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccatcacactggcggccgctcgactagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgatcgaggtcgacggtatcgggggagctcgcagggtctccattttgaagcgggaggtttgaacgcgcagccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggctcttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggc

SEQ ID NO: 19 - DNA, 7335 bp, Artificial Sequence
  AAV packaging construct for AAV genomes with AAV2-ITRs to be packaged into AAV8 capsids
  misc_feature (1)..(7335): AAV2/8 packaging construct; pack 2/8
ccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaattgcctgttaatcaataaaccggttgattcgtttcagttgaactttggtctctgcgaagggcgaattcgtttaaacctgcaggactagagtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccatcacactggcggccgctcgactagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgatcgaggtcgacggtatcgggggagctcgcagggtctccattttgaagcgggaggtttgaacgcgcagccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggctcttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagaga

SEQ ID NO: 20 - DNA, 8011 bp, Artificial Sequence
  AAV packaging construct (plasmid) to package AAV genomes with AAV2-ITRs into capsids of AAV serotype 2
  misc_feature (1)..(8011): AAV2/2 packaging construct; pack 2/2
tctagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccccgagtccttcaatgctatcattccctttgatattggaccatatgcatagtaccgagaaactagtgcgaagtagtgatcaggtattgctgttagatatccccgagtccttcaatgctatcattctctttgatattggaccatatgcatagtaccgagaaactagtgcgaagtagtgatcaggtattgctgttagatatccccgagtccttcaatgctatcattccctttgatattggaccatatgcatagtaccgagaaactagtgcgaagtagtgatcaggtattgctgttagatatccccgagtccttcaatgctatcattctctttgatattggaccatatgcatagtaccgagaaactagtgcgaagtagtgatcaggtattgctgttagatatccccgagtccttcaatgctatcattccctttgatattggaccatatgcatagtaccgagaaactagtgcgaagtagtgatcaggtattgctgttagatatccccgagtccttcaatgctatcatttcctttgatattggatcatatgcatagtaccgagaaactagtgcgaagtagtgatcaggtattgctgttaaggatccatcacactggcggccgctcgaggggagctcgcagggtctccattttgaagcgggaggtttgaacgcgcagccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggctcttttctttgtgcaatttgagaagggagagagctacttccacatgcacgtgctcgtggaaaccaccggggtgaaatccatggttttgggacgtttcctgagtcagattcgcgaaaaactgattcagagaatttaccagcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaattgcttgttaatcaataaaccgtttaattcgtttcagttgaactttggtctctgcgtatttctttcttatctagtttccatgctctagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatgatccactagtaacggccgccagtgtgctggaattcggctttgtagttaatgattaacccggcatgctacttatctacgtagccatgc

SEQ ID NO: 21 - DNA, 8014 bp, Artificial Sequence
  AAV packaging construct for packaging of AAV genomes with AAV2-ITRs into capsids of AAV serotype 1
  misc_feature (1)..(8014): AAV2/1 packaging construct; pack 2/1
tctagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccccgagtccttcaatgctatcattccctttgatattggaccatatgcatagtaccgagaaactagtgcgaagtagtgatcaggtattgctgttagatatccccgagtccttcaatgctatcattctctttgatattggaccatatgcatagtaccgagaaactagtgcgaagtagtgatcaggtattgctgttagatatccccgagtccttcaatgctatcattccctttgatattggaccatatgcatagtaccgagaaactagtgcgaagtagtgatcaggtattgctgttagatatccccgagtccttcaatgctatcattctctttgatattggaccatatgcatagtaccgagaaactagtgcgaagtagtgatcaggtattgctgttagatatccccgagtccttcaatgctatcattccctttgatattggaccatatgcatagtaccgagaaactagtgcgaagtagtgatcaggtattgctgttagatatccccgagtccttcaatgctatcatttcctttgatattggatcatatgcatagtaccgagaaactagtgcgaagtagtgatcaggtattgctgttaaggatccatcacactggcggccgctcgaggggagctcgcagggtctccattttgaagcgggaggtttgaacgcgcagccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggctcttttctttgtgcaatttgagaagggagagagctacttccacatgcacgtgctcgtggaaaccaccggggtgaaatccatggttttgggacgtttcctgagtcagattcgcgaaaaactgattcagagaatttaccagcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaattgcttgttaatcaataaaccgtttaattcgtttcagttgaactttggtctctgcgtatttctttcttatctagtttccatgctctagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatgatccactagtaacggccgccagtgtgctggaattcggctttgtagttaatgattaacccggcatgctacttatctacgtagccatgc

SEQ ID NO: 22 - DNA, 8023 bp, Artificial Sequence
  AAV packaging construct for packaging of AAV genomes with AAV2-ITRs into capsids of bovine AAV
  misc_feature (1)..(8011): AAV2/BAAV packaging construct
  misc_feature (1)..(8011): AAV2/BAAV packaging construct; pack 2/BAAV
tctagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattctgcagatatccccgagtccttcaatgctatcattccctttgatattggaccatatgcatagtaccgagaaactagtgcgaagtagtgatcaggtattgctgttagatatccccgagtccttcaatgctatcattctctttgatattggaccatatgcatagtaccgagaaactagtgcgaagtagtgatcaggtattgctgttagatatccccgagtccttcaatgctatcattccctttgatattggaccatatgcatagtaccgagaaactagtgcgaagtagtgatcaggtattgctgttagatatccccgagtccttcaatgctatcattctctttgatattggaccatatgcatagtaccgagaaactagtgcgaagtagtgatcaggtattgctgttagatatccccgagtccttcaatgctatcattccctttgatattggaccatatgcatagtaccgagaaactagtgcgaagtagtgatcaggtattgctgttagatatccccgagtccttcaatgctatcatttcctttgatattggatcatatgcatagtaccgagaaactagtgcgaagtagtgatcaggtattgctgccgctcgaggggagctcgcagggtctccattttgaagcgggaggtttgaacgcgcagccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggctcttttctttgtgcaatttgagaagggagagagctacttccacatgcacgtgctcgtggaaaccaccggggtgaaatccatggttttgggacgtttcctgagtcagattcgcgaaaaactgattcagagaatttaccagcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatgtcttttgttgaccaccctccagattggttggaatcgatcggcgacggctttcgtgaatttctcggccttgaggcgggtcccccgaaacccaaggccaatcaacagaagcaagataacgctcgaggtcttgtgcttcctgggtacaagtatcttggtcctgggaacggccttgataagggcgatcctgtcaattttgctgacgaggttgcccgagagcacgacctctcctaccagaaacagcttgaggcgggcgataacccttacctcaagtacaaccacgcggacgcagagtttcaggagaaactcgcttctgacacttcttttgggggaaaccttgggaaggctgttttccaggctaaaaagaggattctcgaacctcttggcctggttgagacgccggataaaacggcgcctgcggcaaaaaagaggcctctagagcagagtcctcaagagccagactcctcgagcggagttggcaagaaaggcaaacagcctgccagaaagagactcaactttgacgacgaacctggagccggagacgggcctcccccagaaggaccatcttccggagctatgtctactgagactgaaatgcgtgcagcagctggcggaaatggtggcgatgcgggacaaggtgccgagggagtgggtaatgcctccggtgattggcattgcgattccacttggtcagagagccacgtcaccaccacctcaacccgcacctgggtcctgccgacctacaacaaccacctgtacctgcggctcggctcgagcaacgccagcgacaccttcaacggattctccaccccctggggatactttgactttaaccgcttccactgccacttctcgccaagagactggcaaaggctcatcaacaaccactggggactgcgccccaaaagcatgcaagtccgcatcttcaacatccaagttaaggaggtcacgacgtctaacggggagacgaccgtatccaacaacctcaccagcacggtccagatctttgcggacagcacgtacgagctcccgtacgtgatggatgcaggtcaggagggcagcttgcctcctttccccaacgacgtgttcatggtgcctcagtacgggtactgcggactggtaaccggaggcagctctcaaaaccagacagacagaaatgccttctactgtctggagtactttcccagccagatgctgagaaccggaaacaactttgagatggtgtacaagtttgaaaacgtgcccttccactccatgtacgctcacagccagagcctggataggctgatgaacccgctgctggaccagtacctgtgggagctccagtctaccacctctggaggaactctcaaccagggcaattcagccaccaactttgccaagctgaccaaaacaaacttttctggctaccgcaaaaactggctcccggggcccatgatgaagcagcagagattctccaagactgccagtcaaaactacaagattccccagggaagaaacaacagtctgctccattatgagaccagaactaccctcgacggaagatggagcaattttgccccgggaacggccatggcaaccgcagccaacgacgccaccgacttctctcaggcccagctcatctttgcggggcccaacatcaccggcaacaccaccacagatgccaataacctgatgttcacttcagaagatgaacttagggccaccaacccccgggacactgacctgtttggccacctggcaaccaaccagcaaaacgccaccaccgttcctaccgtagacgacgtggacggagtcggcgtgtacccgggaatggtgtggcaggacagagacatttactaccaagggcccatttgggccaaaattccacacacggatggacactttcacccgtctcctctcattggcggatttggactgaaaagcccgcctccacaaatattcatcaaaaacactcctgtacccgccaatcccgcaacgaccttctctccggccagaatcaacagcttcatcacccagtacagcaccggacaggtggctgtcaaaatagaatgggaaatccagaaggagcggtccaagagatggaacccagaggtccagttcacgtccaactacggagcacaggactcgcttctctgggctcccgacaacgccggagcctacaaagagcccagggccattggatcccgatacctcaccaaccacctctagcccaattctgttgcataccctcaataaaccgtgtattcgtttcagtaaaatactgcctcttgtggtcattcggcgtacaacagcttacaacaacaacaaaacccccttgctagagagtgtggcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatgatccactagtaacggccgccagtgtgctggaattcggctttgtagttaatgattaacccggcatgctacttatctacgtagccatgc

SEQ ID NO: 23 - DNA, 11635 bp, Artificial Sequence
  Adenovirus accesory function helper plasmid; Stratagene
  misc_feature (1)..(11635): Adenovirus accesory function construct (plasmid); pHelper
ggtacccaactccatgcttaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactaggagacactttcaataaaggcaaatgtttttatttgtacactctcgggtgattatttaccccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggtgcatgcccaggctttgagttgcactcgcaccgtagtggcatcagaaggtgaccgtgcccggtctgggcgttaggatacagcgcctgcatgaaagccttgatctgcttaaaagccacctgagcctttgcgccttcagagaagaacatgccgcaagacttgccggaaaactgattggccggacaggccgcgtcatgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgctcccgtgtagacacttaagctcgccttcgatctcagcgcagcggtgcagccacaacgcgcagcccgtgggctcgtggtgcttgtaggttacctctgcaaacgactgcaggtacgcctgcaggaatcgccccatcatcgtcacaaaggtcttgttgctggtgaaggtcagctgcaacccgcggtgctcctcgtttagccaggtcttgcatacggccgccagagcttccacttggtcaggcagtagcttgaagtttgcctttagatcgttatccacgtggtacttgtccatcaacgcgcgcgcagcctccatgcccttctcccacgcagacacgatcggcaggctcagcgggtttatcaccgtgctttcactttccgcttcactggactcttccttttcctcttgcgtccgcataccccgcgccactgggtcgtcttcattcagccgccgcaccgtgcgcttacctcccttgccgtgcttgattagcaccggtgggttgctgaaacccaccatttgtagcgccacatcttctctttcttcctcgctgtccacgatcacctctggggatggcgggcgctcgggcttgggagaggggcgcttctttttctttttggacgcaatggccaaatccgccgtcgaggtcgatggccgcgggctgggtgtgcgcggcaccagcgcatcttgtgacgagtcttcttcgtcctcggactcgagacgccgcctcagccgcttttttgggggcgcgcggggaggcggcggcgacggcgacggggacgacacgtcctccatggttggtggacgtcgcgccgcaccgcgtccgcgctcgggggtggtttcgcgctgctcctcttcccgactggccatttccttctcctataggcagaaaaagatcatggagtcagtcgagaaggaggacagcctaaccgccccctttgagttcgccaccaccgcctccaccgatgccgccaacgcgcctaccaccttccccgtcgaggcacccccgcttgaggaggaggaagtgattatcgagcaggacccaggttttgtaagcgaagacgacgaggatcgctcagtaccaacagaggataaaaagcaagaccaggacgacgcagaggcaaacgaggaacaagtcgggcggggggaccaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctgttctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcgacgaagtgccaaaaatctttgagggtcttggacgcgacgagaaacgcgcggcaaacgctctgcaacaagaaaacagcgaaaatgaaagtcactgtggagtgctggtggaacttgagggtgacaacgcgcgcctagccgtgctgaaacgcagcatcgaggtcacccactttgcctacccggcacttaacctaccccccaaggttatgagcacagtcatgagcgagctgatcgtgcgccgtgcacgacccctggagagggatgcaaacttgcaagaacaaaccgaggagggcctacccgcagttggcgatgagcagctggcgcgctggcttgagacgcgcgagcctgccgacttggaggagcgacgcaagctaatgatggccgcagtgcttgttaccgtggagcttgagtgcatgcagcggttctttgctgacccggagatgcagcgcaagctagaggaaacgttgcactacacctttcgccagggctacgtgcgccaggcctgcaaaatttccaacgtggagctctgcaacctggtctcctaccttggaattttgcacgaaaaccgcctcgggcaaaacgtgcttcattccacgctcaagggcgaggcgcgccgcgactacgtccgcgactgcgtttacttatttctgtgctacacctggcaaacggccatgggcgtgtggcagcaatgcctggaggagcgcaacctaaaggagctgcagaagctgctaaagcaaaacttgaaggacctatggacggccttcaacgagcgctccgtggccgcgcacctggcggacattatcttccccgaacgcctgcttaaaaccctgcaacagggtctgccagacttcaccagtcaaagcatgttgcaaaactttaggaactttatcctagagcgttcaggaattctgcccgccacctgctgtgcgcttcctagcgactttgtgcccattaagtaccgtgaatgccctccgccgctttggggtcactgctaccttctgcagctagccaactaccttgcctaccactccgacatcatggaagacgtgagcggtgacggcctactggagtgtcactgtcgctgcaacctatgcaccccgcaccgctccctggtctgcaattcgcaactgcttagcgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacatccttggccaattgcaagccatcaacaaagcccgccaagagtttctgctacgaaagggacggggggtttacctggacccccagtccggcgaggagctcaacccaatccccccgccgccgcagccctatcagcagccgcgggcccttgcttcccaggatggcacccaaaaagaagctgcagctgccgccgccgccacccacggacgaggaggaatactgggacagtcaggcagaggaggttttggacgaggaggaggagatgatggaagactgggacagcctagacgaagcttccgaggccgaagaggtgtcagacgaaacaccgtcaccctcggtcgcattcccctcgccggcgccccagaaattggcaaccgttcccagcatcgctacaacctccgctcctcaggcgccgccggcactgcctgttcgccgacccaaccgtagatgggacaccactggaaccagggccggtaagtctaagcagccgccgccgttagcccaagagcaacaacagcgccaaggctaccgctcgtggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccctactgcaccggcggcagcggcagcggcagcaacagcagcggtcacacagaagcaaaggcgaccggatagcaagactctgacaaagcccaagaaatccacagcggcggcagcagcaggaggaggagcgctgcgtctggcgcccaacgaacccgtatcgacccgcgagcttagaaataggatttttcccactctgtatgctatatttcaacaaagcaggggccaagaacaagagctgaaaataaaaaacaggtctctgcgctccctcacccgcagctgcctgtatcacaaaagcgaagatcagcttcggcgcacgctggaagacgcggaggctctcttcagcaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcctcgaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcgttttagggcggagtaacttgcatgtattgggaattgtagtttttttaaaatgggaagtgacgtatcgtgggaaaacggaagtgaagatttgaggaagttgtgggttttttggctttcgtttctgggcgtaggttcgcgtgcggttttctgggtgttttttgtggactttaaccgttacgtcattttttagtcctatatatactcgctctgtacttggccctttttacactgtgactgattgagctggtgccgtgtcgagtggtgttttttaataggtttttttactggtaaggctgactgttatggctgccgctgtggaagcgctgtatgttgttctggagcgggagggtgctattttgcctaggcaggagggtttttcaggtgtttatgtgtttttctctcctattaattttgttatacctcctatgggggctgtaatgttgtctctacgcctgcgggtatgtattcccccgggctatttcggtcgctttttagcactgaccgatgttaaccaacctgatgtgtttaccgagtcttacattatgactccggacatgaccgaggaactgtcggtggtgctttttaatcacggtgaccagtttttttacggtcacgccggcatggccgtagtccgtcttatgcttataagggttgtttttcctgttgtaagacaggcttctaatgtttaaatgtttttttttttgttattttattttgtgtttaatgcaggaacccgcagacatgtttgagagaaaaatggtgtctttttctgtggtggttccggaacttacctgcctttatctgcatgagcatgactacgatgtgcttgcttttttgcgcgaggctttgcctgattttttgagcagcaccttgcattttatatcgccgcccatgcaacaagcttacataggggctacgctggttagcatagctccgagtatgcgtgtcataatcagtgtgggttcttttgtcatggttcctggcggggaagtggccgcgctggtccgtgcagacctgcacgattatgttcagctggccctgcgaagggacctacgggatcgcggtatttttgttaatgttccgcttttgaatcttatacaggtctgtgaggaacctgaatttttgcaatcatgattcgctgcttgaggctgaaggtggagggcgctctggagcagatttttacaatggccggacttaatattcgggatttgcttagagacatattgataaggtggcgagatgaaaattatttgggcatggttgaaggtgctggaatgtttatagaggagattcaccctgaagggtttagcctttacgtccacttggacgtgagggcagtttgccttttggaagccattgtgcaacatcttacaaatgccattatctgttctttggctgtagagtttgaccacgccaccggaggggagcgcgttcacttaatagatcttcattttgaggttttggataatcttttggaataaaaaaaaaaaaacatggttcttccagctcttcccgctcctcccgtgtgtgactcgcagaacgaatgtgtaggttggctgggtgtggcttattctgcggtggtggatgttatcagggcagcggcgcatgaaggagtttacatagaacccgaagccagggggcgcctggatgctttgagagagtggatatactacaactactacacagagcgagctaagcgacgagaccggagacgcagatctgtttgtcacgcccgcacctggttttgcttcaggaaatatgactacgtccggcgttccatttggcatgacactacgaccaacacgatctcggttgtctcggcgcactccgtacagtagggatcgcctacctccttttgagacagagacccgcgctaccatactggaggatcatccgctgctgcccgaatgtaacactttgacaatgcacaacgtgagttacgtgcgaggtcttccctgcagtgtgggatttacgctgattcaggaatgggttgttccctgggatatggttctgacgcgggaggagcttgtaatcctgaggaagtgtatgcacgtgtgcctgtgttgtgccaacattgatatcatgacgagcatgatgatccatggttacgagtcctgggctctccactgtcattgttccagtcccggttccctgcagtgcatagccggcgggcaggttttggccagctggtttaggatggtggtggatggcgccatgtttaatcagaggtttatatggtaccgggaggtggtgaattacaacatgccaaaagaggtaatgtttatgtccagcgtgtttatgaggggtcgccacttaatctacctgcgcttgtggtatgatggccacgtgggttctgtggtccccgccatgagctttggatacagcgccttgcactgtgggattttgaacaatattgtggtgctgtgctgcagttactgtgctgatttaagtgagatcagggtgcgctgctgtgcccggaggacaaggcgtctcatgctgcgggcggtgcgaatcatcgctgaggagaccactgccatgttgtattcctgcaggacggagcggcggcggcagcagtttattcgcgcgctgctgcagcaccaccgccctatcctgatgcacgattatgactctacccccatgtaggcgtggacttccccttcgccgcccgttgagcaaccgcaagttggacagcagcctgtggctcagcagctggacagcgacatgaacttaagcgagctgcccggggagtttattaatatcactgatgagcgtttggctcgacaggaaaccgtgtggaatataacacctaagaatatgtctgttacccatgatatgatgctttttaaggccagccggggagaaaggactgtgtactctgtgtgttgggagggaggtggcaggttgaatactagggttctgtgagtttgattaaggtacggtgatcaatataagctatgtggtggtggggctatactactgaatgaaaaatgacttgaaattttctgcaattgaaaaataaacacgttgaaacataacatgcaacaggttcacgattctttattcctgggcaatgtaggagaaggtgtaagagttggtagcaaaagtttcagtggtgtattttccactttcccaggaccatgtaaaagacatagagtaagtgcttacctcgctagtttctgtggattcactagaatcgatgtaggatgttgcccctcctgacgcggtaggagaaggggagggtgccctgcatgtctgccgctgctcttgctcttgccgctgctgaggaggggggcgcatctgccgcagcaccggatgcatctgggaaaagcaaaaaaggggctcgtccctgtttccggaggaatttgcaagcggggtcttgcatgacggggaggcaaacccccgttcgccgcagtccggccggcccgagactcgaaccgggggtcctgcgactcaacccttggaaaataaccctccggctacagggagcgagccacttaatgctttcgctttccagcctaaccgcttacgccgcgcgcggccagtggccaaaaaagctagcgcagcagccgccgcgcctggaaggaagccaaaaggagcgctcccccgttgtctgacgtcgcacacctgggttcgacacgcgggcggtaaccgcatggatcacggcggacggccggatccggggttcgaaccccggtcgtccgccatgatacccttgcgaatttatccaccagaccacggaagagtgcccgcttacaggctctccttttgcacggtctagagcgtcaacgactgcgcacgcctcaccggccagagcgtcccgaccatggagcactttttgccgctgcgcaacatctggaaccgcgtccgcgactttccgcgcgcctccaccaccgccgccggcatcacctggatgtccaggtacatctacggattacgtcgacgtttaaaccatatgatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgatggatcc

SEQ ID NO: 24 - DNA, 10598 bp, Artificial Sequence
  AAV cis plasmid with AAV2-ITRs and ABCA4 expression cassette including RSV promoter and SV40 polyadenylation signal
  misc_structure (248)..(377): AAV2-ITR; 5'
  promoter (457)..(736)
  CDS (738)..(7559): ABCA4 coding sequence
  polyA_signal (7567)..(7803): SV40 late polyadenylation signal
  misc_structure (7905)..(8034): AAV2-ITR; 3'
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccagatttaattaaggctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagctagagtcgacaaagctagcaatgtagtcttatgcaatactcttgcaacatgcttatgtaacgatgagttagcaacatgccttacaaggagagaaaaagcaccgtgcatgacgattggtggaagtaaggtggtacgatcgtgccttattaggaaggcaacagacgggtctgacatggattggacgaaccactgaattccgcattgcagagatattgtatttaagtgcctagctcgatacaataaacgccatttgaccattcaccacactgcagaaagcggccgccatgggcttcgtgagacagatacagcttttgctctggaagaactggaccctgcggaaaaggcaaaagattcgctttgtggtggaactcgtgtggcctttatctttatttctggtcttgatctggttaaggaatgccaacccactctacagccatcatgaatgccatttccccaacaaggcgatgccctcagcaggaatgctgccgtggctccaggggatcttctgcaatgtgaacaatccctgttttcaaagccccaccccaggagaatctcctggaattgtgtcaaactataacaactccatcttggcaagggtatatcgagattttcaagaactcctcatgaatgcaccagagagccagcaccttggccgtatttggacagagctacacatcttgtcccaattcatggacaccctccggactcacccggagagaattgcaggaagaggaatacgaataagggatatcttgaaagatgaagaaacactgacactatttctcattaaaaacatcggcctgtctgactcagtggtctaccttctgatcaactctcaagtccgtccagagcagttcgctcatggagtcccggacctggcgctgaaggacatcgcctgcagcgaggccctcctggagcgcttcatcatcttcagccagagacgcggggcaaagacggtgcgctatgccctgtgctccctctcccagggcaccctacagtggatagaagacactctgtatgccaacgtggacttcttcaagctcttccgtgtgcttcccacactcctagacagccgttctcaaggtatcaatctgagatcttggggaggaatattatctgatatgtcaccaagaattcaagagtttatccatcggccgagtatgcaggacttgctgtgggtgaccaggcccctcatgcagaatggtggtccagagacctttacaaagctgatgggcatcctgtctgacctcctgtgtggctaccccgagggaggtggctctcgggtgctctccttcaactggtatgaagacaataactataaggcctttctggggattgactccacaaggaaggatcctatctattcttatgacagaagaacaacatccttttgtaatgcattgatccagagcctggagtcaaatcctttaaccaaaatcgcttggagggcggcaaagcctttgctgatgggaaaaatcctgtacactcctgattcacctgcagcacgaaggatactgaagaatgccaactcaacttttgaagaactggaacacgttaggaagttggtcaaagcctgggaagaagtagggccccagatctggtacttctttgacaacagcacacagatgaacatgatcagagataccctggggaacccaacagtaaaagactttttgaataggcagcttggtgaagaaggtattactgctgaagccatcctaaacttcctctacaagggccctcgggaaagccaggctgacgacatggccaacttcgactggagggacatatttaacatcactgatcgcaccctccgcctggtcaatcaatacctggagtgcttggtcctggataagtttgaaagctacaatgatgaaactcagctcacccaacgtgccctctctctactggaggaaaacatgttctgggccggagtggtattccctgacatgtatccctggaccagctctctaccaccccacgtgaagtataagatccgaatggacatagacgtggtggagaaaaccaataagattaaagacaggtattgggattctggtcccagagctgatcccgtggaagatttccggtacatctggggcgggtttgcctatctgcaggacatggttgaacaggggatcacaaggagccaggtgcaggcggaggctccagttggaatctacctccagcagatgccctacccctgcttcgtggacgattctttcatgatcatcctgaaccgctgtttccctatcttcatggtgctggcatggatctactctgtctccatgactgtgaagagcatcgtcttggagaaggagttgcgactgaaggagaccttgaaaaatcagggtgtctccaatgcagtgatttggtgtacctggttcctggacagcttctccatcatgtcgatgagcatcttcctcctgacgatattcatcatgcatggaagaatcctacattacagcgacccattcatcctcttcctgttcttgttggctttctccactgccaccatcatgctgtgctttctgctcagcaccttcttctccaaggccagtctggcagcagcctgtagtggtgtcatctatttcaccctctacctgccacacatcctgtgcttcgcctggcaggaccgcatgaccgctgagctgaagaaggctgtgagcttactgtctccggtggcatttggatttggcactgagtacctggttcgctttgaagagcaaggcctggggctgcagtggagcaacatcgggaacagtcccacggaaggggacgaattcagcttcctgctgtccatgcagatgatgctccttgatgctgctgtctatggcttactcgcttggtaccttgatcaggtgtttccaggagactatggaaccccacttccttggtactttcttctacaagagtcgtattggcttggcggtgaagggtgttcaaccagagaagaaagagccctggaaaagaccgagcccctaacagaggaaacggaggatccagagcacccagaaggaatacacgactccttctttgaacgtgagcatccagggtgggttcctggggtatgcgtgaagaatctggtaaagatttttgagccctgtggccggccagctgtggaccgtctgaacatcaccttctacgagaaccagatcaccgcattcctgggccacaatggagctgggaaaaccaccaccttgtccatcctgacgggtctgttgccaccaacctctgggactgtgctcgttgggggaagggacattgaaaccagcctggatgcagtccggcagagccttggcatgtgtccacagcacaacatcctgttccaccacctcacggtggctgagcacatgctgttctatgcccagctgaaaggaaagtcccaggaggaggcccagctggagatggaagccatgttggaggacacaggcctccaccacaagcggaatgaagaggctcaggacctatcaggtggcatgcagagaaagctgtcggttgccattgcctttgtgggagatgccaaggtggtgattctggacgaacccacctctggggtggacccttactcgagacgctcaatctgggatctgctcctgaagtatcgctcaggcagaaccatcatcatgtccactcaccacatggacgaggccgacctccttggggaccgcattgccatcattgcccagggaaggctctactgctcaggcaccccactcttcctgaagaactgctttggcacaggcttgtacttaaccttggtgcgcaagatgaaaaacatccagagccaaaggaaaggcagtgaggggacctgcagctgctcgtctaagggtttctccaccacgtgtccagcccacgtcgatgacctaactccagaacaagtcctggatggggatgtaaatgagctgatggatgtagttctccaccatgttccagaggcaaagctggtggagtgcattggtcaagaacttatcttccttcttccaaataagaacttcaagcacagagcatatgccagccttttcagagagctggaggagacgctggctgaccttggtctcagcagttttggaatttctgacactcccctggaagagatttttctgaaggtcacggaggattctgattcaggacctctgtttgcgggtggcgctcagcagaaaagagaaaacgtcaacccccgacacccctgcttgggtcccagagagaaggctggacagacaccccaggactccaatgtctgctccccaggggcgccggctgctcacccagagggccagcctcccccagagccagagtgcccaggcccgcagctcaacacggggacacagctggtcctccagcatgtgcaggcgctgctggtcaagagattccaacacaccatccgcagccacaaggacttcctggcgcagatcgtgctcccggctacctttgtgtttttggctctgatgctttctattgttatccctccttttggcgaataccccgctttgacccttcacccctggatatatgggcagcagtacaccttcttcagcatggatgaaccaggcagtgagcagttcacggtacttgcagacgtcctcctgaataagccaggctttggcaaccgctgcctgaaggaagggtggcttccggagtacccctgtggcaactcaacaccctggaagactccttctgtgtccccaaacatcacccagctgttccagaagcagaaatggacacaggtcaacccttcaccatcctgcaggtgcagcaccagggagaagctcaccatgctgccagagtgccccgagggtgccgggggcctcccgcccccccagagaacacagcgcagcacggaaattctacaagacctgacggacaggaacatctccgacttcttggtaaaaacgtatcctgctcttataagaagcagcttaaagagcaaattctgggtcaatgaacagaggtatggaggaatttccattggaggaaagctcccagtcgtccccatcacgggggaagcacttgttgggtttttaagcgaccttggccggatcatgaatgtgagcgggggccctatcactagagaggcctctaaagaaatacctgatttccttaaacatctagaaactgaagacaacattaaggtgtggtttaataacaaaggctggcatgccctggtcagctttctcaatgtggcccacaacgccatcttacgggccagcctgcctaaggacaggagccccgaggagtatggaatcaccgtcattagccaacccctgaacctgaccaaggagcagctctcagagattacagtgctgaccacttcagtggatgctgtggttgccatctgcgtgattttctccatgtccttcgtcccagccagctttgtcctttatttgatccaggagcgggtgaacaaatccaagcacctccagtttatcagtggagtgagccccaccacctactgggtgaccaacttcctctgggacatcatgaattattccgtgagtgctgggctggtggtgggcatcttcatcgggtttcagaagaaagcctacacttctccagaaaaccttcctgcccttgtggcactgctcctgctgtatggatgggcggtcattcccatgatgtacccagcatccttcctgtttgatgtccccagcacagcctatgtggctttatcttgtgctaatctgttcatcggcatcaacagcagtgctattaccttcatcttggaattatttgagaataaccggacgctgctcaggttcaacgccgtgctgaggaagctgctcattgtcttcccccacttctgcctgggccggggcctcattgaccttgcactgagccaggctgtgacagatgtctatgcccggtttggtgaggagcactctgcaaatccgttccactgggacctgattgggaagaacctgtttgccatggtggtggaaggggtggtgtacttcctcctgaccctgctggtccagcgccacttcttcctctcccaatggattgccgagcccactaaggagcccattgttgatgaagatgatgatgtggctgaagaaagacaaagaattattactggtggaaataaaactgacatcttaaggctacatgaactaaccaagatttatccaggcacctccagcccagcagtggacaggctgtgtgtcggagttcgccctggagagtgctttggcctcctgggagtgaatggtgccggcaaaacaaccacattcaagatgctcactggggacaccacagtgacctcaggggatgccaccgtagcaggcaagagtattttaaccaatatttctgaagtccatcaaaatatgggctactgtcctcagtttgatgcaattgatgagctgctcacaggacgagaacatctttacctttatgcccggcttcgaggtgtaccagcagaagaaatcgaaaaggttgcaaactggagtattaagagcctgggcctgactgtctacgccgactgcctggctggcacgtacagtgggggcaacaagcggaaactctccacagccatcgcactcattggctgcccaccgctggtgctgctggatgagcccaccacagggatggacccccaggcacgccgcatgctgtggaacgtcatcgtgagcatcatcagagaagggagggctgtggtcctcacatcccacagcatggaagaatgtgaggcactgtgtacccggctggccatcatggtaaagggcgcctttcgatgtatgggcaccattcagcatctcaagtccaaatttggagatggctatatcgtcacaatgaagatcaaatccccgaaggacgacctgcttcctgacctgaaccctgtggagcagttcttccaggggaacttcccaggcagtgtgcagagggagaggcactacaacatgctccagttccaggtctcctcctcctccctggcgaggatcttccagctcctcctctcccacaaggacagcctgctcatcgaggagtactcagtcacacagaccacactggaccaggtgtttgtaaattttgctaaacagcagactgaaagtcatgacctccctctgcaccctcgagctgctggagccagtcgacaagcccaggactgataagcttggatctttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaaaactcgagattctagagtcgagttaagggcgaattcccgattaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagccttaattaacctaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccccgatagacggtttttcgccctttgacgctggagttcacgttcctcaatagtggactcttgttccaaactggaacaacactcaaccctatctcggtctattcttttgatttataagggatttttccgatttcggcctattggttaaaaaatgagctgatttaacaaaaatttaacgcgaattttaacaaaatattaacgtttataatttcaggtggcatctttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaatagtggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagtaatggtaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctgcggttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 25 - protein, 2273 aa, Artificial Sequence [sequence omitted]

SEQ ID NO: 26 - DNA, 9365 bp, Artificial Sequence
  AAV cis plasmid with AAV2-ITRs and expression cassette for human minidystrophin gene under the control of the RSV promoter and the late SV40 polyadenylation signal
  misc_structure (248)..(377): AAV2-ITR; 5'
  promoter (457)..(736): RSV promoter
  CDS (738)..(6326): minidystrophin coding sequence
  polyA_signal (6334)..(6570): SV40 late polyadenylation signal
  misc_structure (6672)..(6801): AAV2-ITR; 3'
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccagatttaattaaggctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagctagagtcgacaaagctagcaatgtagtcttatgcaatactcttgcaacatgcttatgtaacgatgagttagcaacatgccttacaaggagagaaaaagcaccgtgcatgacgattggtggaagtaaggtggtacgatcgtgccttattaggaaggcaacagacgggtctgacatggattggacgaaccactgaattccgcattgcagagatattgtatttaagtgcctagctcgatacaataaacgccatttgaccattcaccacactgcagaaagcggccgccatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacaggttcaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtagtaagcttggatctttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaaaactcgagattctagagtcgagttaagggcgaattcccgattaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagccttaattaacctaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccccgatagacggtttttcgccctttgacgctggagttcacgttcctcaatagtggactcttgttccaaactggaacaacactcaaccctatctcggtctattcttttgatttataagggatttttccgatttcggcctattggttaaaaaatgagctgatttaacaaaaatttaacgcgaattttaacaaaatattaacgtttataatttcaggtggcatctttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaatagtggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagtaatggtaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctgcggttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 27 - protein, 1862 aa, Artificial Sequence; identical to SEQ ID NO: 10
  Synthetic Construct

SEQ ID NO: 28 - DNA, 10832 bp, Artificial Sequence
  AAV cis plasmid with AAV2-ITRs and human Factor VIII expression cassette
  misc_structure (248)..(377): AAV2-ITR; 5'
  promoter (457)..(736): RSV promoter
  CDS (738)..(7793): Factor VIII coding sequence
  polyA_signal (7801)..(8037): SV40 late polyadenylation signal
  misc_structure (8139)..(8268): AAV2-ITR; 3'
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccagatttaattaaggctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagctagagtcgacaaagctagcaatgtagtcttatgcaatactcttgcaacatgcttatgtaacgatgagttagcaacatgccttacaaggagagaaaaagcaccgtgcatgacgattggtggaagtaaggtggtacgatcgtgccttattaggaaggcaacagacgggtctgacatggattggacgaaccactgaattccgcattgcagagatattgtatttaagtgcctagctcgatacaataaacgccatttgaccattcaccacactgcagaaagcggccgccatgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccgtagcactaggcaaaagcaatttaatgccaccacaattccagaaaatgacatagagaagactgacccttggtttgcacacagaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgacggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactgataagcttggatctttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaaaactcgagattctagagtcgagttaagggcgaattcccgattaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagccttaattaacctaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccccgatagacggtttttcgccctttgacgctggagttcacgttcctcaatagtggactcttgttccaaactggaacaacactcaaccctatctcggtctattcttttgatttataagggatttttccgatttcggcctattggttaaaaaatgagctgatttaacaaaaatttaacgcgaattttaacaaaatattaacgtttataatttcaggtggcatctttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaatagtggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagtaatggtaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctgcggttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 29 - protein, 2351 aa, Artificial Sequence [sequence omitted]

SEQ ID NO: 30 - DNA, 8546 bp, Artificial Sequence
  AAV cis plasmid harboring B-deleted Factor VIII expression cassette with CMV promoter; expression cassette is flanked by AAV2-ITRs
  misc_feature (248)..(377): AAV2-ITR; 5'
  promoter (457)..(1078): CMV promoter
  CDS (1080)..(5507): B-deleted Factor VIII coding sequence
  polyA_signal (5515)..(5751): SV40 late polyadenylation signal
  misc_feature (5853)..(5982): AAV2-ITR; 3'
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccagatttaattaaggctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagctagagtcgacaaagctagctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcctgcagaaagcggccgccatgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttcaagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactgataagcttggatctttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaaaactcgagattctagagtcgagttaagggcgaattcccgattaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagccttaattaacctaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccccgatagacggtttttcgccctttgacgctggagttcacgttcctcaatagtggactcttgttccaaactggaacaacactcaaccctatctcggtctattcttttgatttataagggatttttccgatttcggcctattggttaaaaaatgagctgatttaacaaaaatttaacgcgaattttaacaaaatattaacgtttataatttcaggtggcatctttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaatagtggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagtaatggtaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctgcggttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 31 - protein, 1475 aa, Artificial Sequence; identical to SEQ ID NO: 6
  Synthetic Construct

SEQ ID NO: 32 - DNA, 4443 bp, Homo sapiens
  CDS (1)..(4443): CFTR coding sequence
atgcagaggtcgcctctggaaaaggccagcgttgtctccaaactttttttcagctggaccagaccaattttgaggaaaggatacagacagcgcctggaattgtcagacatataccaaatcccttctgttgattctgctgacaatctatctgaaaaattggaaagagaatgggatagagagctggcttcaaagaaaaatcctaaactcattaatgcccttcggcgatgttttttctggagatttatgttctatggaatctttttatatttaggggaagtcaccaaagcagtacagcctctcttactgggaagaatcatagcttcctatgacccggataacaaggaggaacgctctatcgcgatttatctaggcataggcttatgccttctctttattgtgaggacactgctcctacacccagccatttttggccttcatcacattggaatgcagatgagaatagctatgtttagtttgatttataagaagactttaaagctgtcaagccgtgttctagataaaataagtattggacaacttgttagtctcctttccaacaacctgaacaaatttgatgaaggacttgcattggcacatttcgtgtggatcgctcctttgcaagtggcactcctcatggggctaatctgggagttgttacaggcgtctgccttctgtggacttggtttcctgatagtccttgccctttttcaggctgggctagggagaatgatgatgaagtacagagatcagagagctgggaagatcagtgaaagacttgtgattacctcagaaatgattgaaaatatccaatctgttaaggcatactgctgggaagaagcaatggaaaaaatgattgaaaacttaagacaaacagaactgaaactgactcggaaggcagcctatgtgagatacttcaatagctcagccttcttcttctcagggttctttgtggtgtttttatctgtgcttccctatgcactaatcaaaggaatcatcctccggaaaatattcaccaccatctcattctgcattgttctgcgcatggcggtcactcggcaatttccctgggctgtacaaacatggtatgactctcttggagcaataaacaaaatacaggatttcttacaaaagcaagaatataagacattggaatataacttaacgactacagaagtagtgatggagaatgtaacagccttctgggaggagggatttggggaattatttgagaaagcaaaacaaaacaataacaatagaaaaacttctaatggtgatgacagcctcttcttcagtaatttctcacttcttggtactcctgtcctgaaagatattaatttcaagatagaaagaggacagttgttggcggttgctggatccactggagcaggcaagacttcacttctaatgatgattatgggagaactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagcatgccaactagaagaggacatctccaagtttgcagagaaagacaatatagttcttggagaaggtggaatcacactgagtggaggtcaacgagcaagaatttctttagcaagagcagtatacaaagatgctgatttgtatttattagactctccttttggatacctagatgttttaacagaaaaagaaatatttgaaagctgtgtctgtaaactgatggctaacaaaactaggattttggtcacttctaaaatggaacatttaaagaaagctgacaaaatattaattttgcatgaaggtagcagctatttttatgggacattttcagaactccaaaatctacagccagactttagctcaaaactcatgggatgtgattctttcgaccaatttagtgcagaaagaagaaattcaatcctaactgagaccttacaccgtttctcattagaaggagatgctcctgtctcctggacagaaacaaaaaaacaatcttttaaacagactggagagtttggggaaaaaaggaagaattctattctcaatccaatcaactctatacgaaaattttccattgtgcaaaagactcccttacaaatgaatggcatcgaagaggattctgatgagcctttagagagaaggctgtccttagtaccagattctgagcagggagaggcgatactgcctcgcatcagcgtgatcagcactggccccacgcttcaggcacgaaggaggcagtctgtcctgaacctgatgacacactcagttaaccaaggtcagaacattcaccgaaagacaacagcatccacacgaaaagtgtcactggcccctcaggcaaacttgactgaactggatatatattcaagaaggttatctcaagaaactggcttggaaataagtgaagaaattaacgaagaagacttaaaggagtgcttttttgatgatatggagagcataccagcagtgactacatggaacacataccttcgatatattactgtccacaagagcttaatttttgtgctaatttggtgcttagtaatttttctggcagaggtggctgcttctttggttgtgctgtggctccttggaaacactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtgggattcttaatagattctccaaagatatagcaattttggatgaccttctgcctcttaccatatttgacttcatccagttgttattaattgtgattggagctatagcagttgtcgcagttttacaaccctacatctttgttgcaacagtgccagtgatagtggcttttattatgttgagagcatatttcctccaaacctcacagcaactcaaacaactggaatctgaaggcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggagaaggagaaggaagagttggtattatcctgactttagccatgaatatcatgagtacattgcagtgggctgtaaactccagcatagatgtggatagcttgatgcgatctgtgagccgagtctttaagttcattgacatgccaacagaaggtaaacctaccaagtcaaccaaaccatacaagaatggccaactctcgaaagttatgattattgagaattcacacgtgaagaaagatgacatctggccctcagggggccaaatgactgtcaaagatctcacagcaaaatacacagaaggtggaaatgccatattagagaacatttccttctcaataagtcctggccagagggtgggcctcttgggaagaactggatcagggaagagtactttgttatcagcttttttgagactactgaacactgaaggagaaatccagatcgatggtgtgtcttgggattcaataactttgcaacagtggaggaaagcctttggagtgataccacagaaagtatttattttttctggaacatttagaaaaaacttggatccctatgaacagtggagtgatcaagaaatatggaaagttgcagatgaggttgggctcagatctgtgatagaacagtttcctgggaagcttgactttgtccttgtggatgggggctgtgtcctaagccatggccacaagcagttgatgtgcttggctagatctgttctcagtaaggcgaagatcttgctgcttgatgaacccagtgctcatttggatccagtaacataccaaataattagaagaactctaaaacaagcatttgctgattgcacagtaattctctgtgaacacaggatagaagcaatgctggaatgccaacaatttttggtcatagaagagaacaaagtgcggcagtacgattccatccagaaactgctgaacgagaggagcctcttccggcaagccatcagcccctccgacagggtgaagctctttccccaccggaactcaagcaagtgcaagtctaagccccagattgctgctctgaaagaggagacagaagaagaggtgcaagatacaaggctttag

SEQ ID NO: 33 - protein, 1480 aa, Homo sapiens
MQRSPLEKASVVSKLFFSWTRPILRKGYRQRLELSDIYQIPSVDSADNLSEKLEREWDRELASKKNPKLINALRRCFFWRFMFYGIFLYLGEVTKAVQPLLLGRIIASYDPDNKEERSIAIYLGIGLCLLFIVRTLLLHPAIFGLHHIGMQMRIAMFSLIYKKTLKLSSRVLDKISIGQLVSLLSNNLNKFDEGLALAHFVWIAPLQVALLMGLIWELLQASAFCGLGFLIVLALFQAGLGRMMMKYRDQRAGKISERLVITSEMIENIQSVKAYCWEEAMEKMIENLRQTELKLTRKAAYVRYFNSSAFFFSGFFVVFLSVLPYALIKGIILRKIFTTISFCIVLRMAVTRQFPWAVQTWYDSLGAINKIQDFLQKQEYKTLEYNLTTTEVVMENVTAFWEEGFGELFEKAKQNNNNRKTSNGDDSLFFSNFSLLGTPVLKDINFKIERGQLLAVAGSTGAGKTSLLMMIMGELEPSEGKIKHSGRISFCSQFSWIMPGTIKENIIFGVSYDEYRYRSVIKACQLEEDISKFAEKDNIVLGEGGITLSGGQRARISLARAVYKDADLYLLDSPFGYLDVLTEKEIFESCVCKLMANKTRILVTSKMEHLKKADKILILHEGSSYFYGTFSELQNLQPDFSSKLMGCDSFDQFSAERRNSILTETLHRFSLEGDAPVSWTETKKQSFKQTGEFGEKRKNSILNPINSIRKFSIVQKTPLQMNGIEEDSDEPLERRLSLVPDSEQGEAILPRISVISTGPTLQARRRQSVLNLMTHSVNQGQNIHRKTTASTRKVSLAPQANLTELDIYSRRLSQETGLEISEEINEEDLKECFFDDMESIPAVTTWNTYLRYITVHKSLIFVLIWCLVIFLAEVAASLVVLWLLGNTPLQDKGNSTHSRNNSYAVIITSTSSYYVFYIYVGVADTLLAMGFFRGLPLVHTLITVSKILHHKMLHSVLQAPMSTLNTLKAGGILNRFSKDIAILDDLLPLTIFDFIQLLLIVIGAIAVVAVLQPYIFVATVPVIVAFIMLRAYFLQTSQQLKQLESEGRSPIFTHLVTSLKGLWTLRAFGRQPYFETLFHKALNLHTANWFLYLSTLRWFQMRIEMIFVIFFIAVTFISILTTGEGEGRVGIILTLAMNIMSTLQWAVNSSIDVDSLMRSVSRVFKFIDMPTEGKPTKSTKPYKNGQLSKVMIIENSHVKKDDIWPSGGQMTVKDLTAKYTEGGNAILENISFSISPGQRVGLLGRTGSGKSTLLSAFLRLLNTEGEIQIDGVSWDSITLQQWRKAFGVIPQKVFIFSGTFRKNLDPYEQWSDQEIWKVADEVGLRSVIEQFPGKLDFVLVDGGCVLSHGHKQLMCLARSVLSKAKILLLDEPSAHLDPVTYQIIRRTLKQAFADCTVILCEHRIEAMLECQQFLVIEENKVRQYDSIQKLLNERSLFRQAISPSDRVKLFPHRNSSKCKSKPQIAALKEETEEEVQDTRL

SEQ ID NO: 34 - DNA, 4641 bp, Homo sapiens
  CDS (1)..(4641): Usherin 2a coding sequence
atgaattgcccagttctttcattgggctctggcttcttgtttcaggtcattgaaatgttgatctttgcctattttgcttcaatatccttgactgagtcacgaggtcttttcccaaggctggagaacgtgggagctttcaagaaagtttccatcgtgccaacccaagcagtatgtggactcccagaccgaagcactttttgtcacagctctgctgctgctgaaagtattcagttctgtacccagcggttttgtattcaggattgcccatacagatcttcacaccctacctacactgcccttttctcagcaggcctcagtagctgcatcacaccagacaagaatgatctgcatcctaacgcccatagcaattctgcaagttttatttttggaaatcacaagagctgcttttcttctcctccttctccaaagctgatggcatcatttaccttagctgtatggctgaaacctgagcaacaaggtgtaatgtgtgttatagaaaagacagtagatgggcagattgtgttcaaacttacaatatctgagaaagagaccatgttttattatcgcacagtaaatggtttgcaacctccaataaaagtaatgacactggggagaattcttgtgaagaaatggattcatcttagtgtgcaggtgcatcagacaaaaatcagcttctttatcaatggcgtggagaaggatcatacacctttcaatgcaagaactctaagtggttcaattacagattttgcatctggtactgtgcaaataggacagagtttaaatggtttagagcagtttgtcggaagaatgcaagattttcgattataccaagtggcacttacaaacagagagattctggaagtcttctctggagatcttctcagattgcatgcccaatcacattgccgttgccctggcagccacccgcgggtccaccctttggcacagcggtactgcattcctaatgatgcaggagacacagctgataatagagtgtcacggttgaatcctgaagcccatcctctctcttttgtcaatgataatgatgttggtacttcatgggtttcaaatgtgtttacaaacattacacagcttaatcaaggagtgactatttcagttgatttggaaaatggacagtatcaggtgttttatattatcattcagttctttagtccacaaccaacggaaataaggattcaaaggaagaaggaaaatagtttagattgggaggactggcaatattttgccaggaattgtggtgcttttggaatgaaaaacaatggagatttggaaaaacctgattctgtcaactgtcttcagctttccaattttactccatattcccgtggcaatgtcacatttagcatcctgacacctggaccaaattatcgtcctggatacaataacttctataataccccatctcttcaagagtccgtaaaagccacgcaaataaggtttcattttcatgggcagtactatacaactgagactgctgttaacctcagacacagatattatgcagtggacgaaatcaccattagtgggagatgtcagtgccatggtcatgccgataactgcgacacaacaagccagccatatagatgcctctgctcccaggagagcttcactgaaggacttcattgtgatcgctgcttgcctctttataatgacaagcctttccgccaaggtgatcaagtttacgctttcaattgtaaaccttgtcaatgcaacagccattccaaaagctgccattacaacatctctgtagacccatttccttttgagcacttcagagggggaggaggagtttgtgatgattgtgagcataacactacaggaaggaactgtgagctgtgcaaggattactttttccgacaagttggtgcagatccttcggccatagatgtttgcaaaccctgtgactgtgatacagttggcactagaaatggtagcattctttgtgatcagattggaggacagtgtaattgtaagagacacgtgtctggcaggcagtgcaatcagtgccagaatggattctacaatctacaagagttggatcctgatggctgcagtccctgtaactgcaatacctctgggacagtggatggagatattacctgtcaccaaaattcaggccagtgcaagtgcaaagcaaacgttattgggcttaggtgtgatcattgcaattttggatttaaatttctccgaagctttaatgatgttggatgtgagccctgccagtgtaacctccatggctcagtgaacaaattctgcaatcctcactctgggcagtgtgagtgcaaaaaagaagccaaaggacttcagtgtgacacctgcagagaaaacttttatgggttagatgtcaccaattgtaaggcctgtgactgtgacacagctggatccctccctgggactgtctgtaatgctaagacagggcagtgcatctgcaagcccaatgttgaagggagacagtgcaataaatgtttggagggaaacttctacctacggcaaaataattctttcctctgtctgccttgcaactgtgataagactgggacaataaatggctctctgctgtgtaacaaatcaacaggacaatgtccttgcaaattaggggtaacaggtcttcgctgtaatcagtgtgagcctcacaggtacaatttgaccattgacaattttcaacactgccagatgtgtgagtgtgattccttggggacattacctgggaccatttgtgacccaatcagtggccagtgcctgtgtgtgcctaatcgtcaaggaagaaggtgtaatcagtgtcaaccaggtttttatatttctccaggcaatgccactggctgcctgccatgctcatgccatacaactggcgcagttaatcacatctgtaatagcctgactggtcagtgtgtttgccaagatgcttccattgctgggcaacgttgtgaccaatgcaaagaccattactttggatttgatcctcagactggaagatgtcagccttgtaattgtcatctctcaggagccttgaatgaaacctgtcacttggtcacaggccagtgtttctgtaaacaatttgtcactggctcaaagtgtgatgcttgtgttcccagtgcaagccacttggatgtcaacaatctattgggttgcagcaaaactccattccagcaacctccgcccagaggacaagttcaaagttcttctgctatcaatctctcctggagtccacctgattctccaaatgcccactggcttacttacagtttactcagggatggttttgaaatctacacaacagaggatcaatacccatacagtattcaatacttcttagacacagacctgttaccatataccaaatattcctattacattgagaccaccaatgtgcatggttcaacaaggagtgtagctgtcacttacaagacaaaaccaggggtcccagagggaaacttgactttaagttatatcattcctattggctcagactctgtgacacttacctggacaacactctcaaatcaatctggtcccatagagaaatatattttgtcctgtgcccctttggctggtggtcagccatgtgtttcctacgaaggtcatgaaacctcagctaccatctggaatctggttccatttgccaagtacgatttttctgtacaggcgtgtactagcgggggctgtttacacagcttgcccattacagtgaccacagcccaggcccctccccaaagactaagtccacctaagatgcagaaaatcagttctacagaacttcatgtagaatggtctccaccagcggaactaaatggaataattataagatatgaactatacatgagaagactgagatctactaaagaaaccacatctgaggaaagtcgagtttttcagagcagtggttggctcagtcctcattcatttgtagaatcggccaatgaaaatgcattaaaacctcctcaaacaatgacaaccatcactggcttggagccatacaccaagtatgagttcagagtcttagctgtgaatatggctggaagtgtgtcttctgcctgggtctcagaaagaacgggagaatcagcacctgtattcatgatccctccttcagtctttcccctctcttcgtactctctcaatatctcctgggagaagccagcagataatgttacaagaggaaaagttgtggggtatgacatcaatatgctttctgaacaatcacctcaacagtctattcccatggcgttttcacagctgttgcacactgctaaatcccaagaactatcttacactgtagaaggactgaaaccttataggatatatgagtttactattactctctgcaattcagttggttgtgtgaccagtgcttcgggagcaggacaaactttagcagcagcaccagcacaactgaggccacctctggttaaaggaatcaacagcacaacaatccatcttaagtggtttccacctgaagaactgaatggaccctctcctatatatcagctggaaaggagagagtcatctctaccagctctgatgaccacgatgatgaaaggaatccgtttcataggaaatgggtattgtaaatttcccagctccactcacccagtcaatacagacttcactggtaagtgtgtttga

SEQ ID NO: 35 - protein, 1546 aa, Homo sapiens [sequence omitted]

SEQ ID NO: 36 - DNA, 10649 bp, Artificial Sequence
  AAV cis plasmid harboring Factor VIII expression cassette flanked by AAV2-ITRs; short synthetic polyadenylation signal
  misc_feature (248)..(377): AAV2-ITR; 5'
  promoter (457)..(736): RSV promoter
  CDS (738)..(7793): Factor VIII coding sequence
  polyA_signal (7795)..(7860): synthetic polyadenylation signal
  misc_feature (7956)..(8085): AAV2-ITR; 3'
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccagatttaattaaggctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagctagagtcgacaaagctagcaatgtagtcttatgcaatactcttgcaacatgcttatgtaacgatgagttagcaacatgccttacaaggagagaaaaagcaccgtgcatgacgattggtggaagtaaggtggtacgatcgtgccttattaggaaggcaacagacgggtctgacatggattggacgaaccactgaattccgcattgcagagatattgtatttaagtgcctagctcgatacaataaacgccatttgaccattcaccacactgcagaaagcggccgccatgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccgtagcactaggcaaaagcaatttaatgccaccacaattccagaaaatgacatagagaagactgacccttggtttgcacacagaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgacggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactgataagcttggatccaataaaagatctttattttcattagatctgtgtgttggttttttgtgtctcgagattctagagtcgagttaagggcgaattcccgattaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagccttaattaacctaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccccgatagacggtttttcgccctttgacgctggagttcacgttcctcaatagtggactcttgttccaaactggaacaacactcaaccctatctcggtctattcttttgatttataagggatttttccgatttcggcctattggttaaaaaatgagctgatttaacaaaaatttaacgcgaattttaacaaaatattaacgtttataatttcaggtggcatctttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaatagtggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagtaatggtaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctgcggttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 37 - protein, 2351 aa, Artificial Sequence [sequence omitted]

SEQ ID NO: 38 - DNA, 6437 bp, Artificial Sequence
  AAV cis plasmid with AAV2-ITRs and firefly luciferase expression cassette
  misc_structure (248)..(377): AAV2-ITR 5'
  promoter (458)..(1040): CMV promoter
  CDS (1228)..(2880): firefly luciferase coding sequence
  misc_feature (2894)..(3435): WPRE element
  polyA_signal (3442)..(3656): bovine growth hormone polyadenylation signal
  misc_structure (3744)..(3873): AAV2-ITR 3'
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccagatttaattaaggctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagctagctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccaggcggccgccatggaagacgccaaaaacataaagaaaggcccggcgccattctatcctctagaggatggaaccgctggagagcaactgcataaggctatgaagagatacgccctggttcctggaacaattgcttttacagatgcacatatcgaggtgaacatcacgtacgcggaatacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgaacatttcgcagcctaccgtagtgtttgtttccaaaaaggggttgcaaaaaattttgaacgtgcaaaaaaaattaccaataatccagaaaattattatcatggattctaaaacggattaccagggatttcagtcgatgtacacgttcgtcacatctcatctacctcccggttttaatgaatacgattttgtaccagagtcctttgatcgtgacaaaacaattgcactgataatgaattcctctggatctactgggttacctaagggtgtggcccttccgcatagaactgcctgcgtcagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttttacgatcccttcaggattacaaaattcaaagtgcgttgctagtaccaaccctattttcattcttcgccaaaagcactctgattgacaaatacgatttatctaatttacacgaaattgcttctgggggcgcacctctttcgaaagaagtcggggaagcggttgcaaaacgcttccatcttccagggatacgacaaggatatgggctcactgagactacatcagctattctgattacacccgagggggatgataaaccgggcgcggtcggtaaagttgttccattttttgaagcgaaggttgtggatctggataccgggaaaacgctgggcgttaatcagagaggcgaattatgtgtcagaggacctatgattatgtccggttatgtaaacaatccggaagcgaccaacgccttgattgacaaggatggatggctacattctggagacatagcttactgggacgaagacgaacacttcttcatagttgaccgcttgaagtctttaattaaatacaaaggatatcaggtggcccccgctgaattggaatcgatattgttacaacaccccaacatcttcgacgcgggcgtggcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagtccaaattgtaataagcttggatccaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgagatctgcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggactcgagttaagggcgaattcccgattaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagccttaattaacctaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccccgatagacggtttttcgccctttgacgctggagttcacgttcctcaatagtggactcttgttccaaactggaacaacactcaaccctatctcggtctattcttttgatttataagggatttttccgatttcggcctattggttaaaaaatgagctgatttaacaaaaatttaacgcgaattttaacaaaatattaacgtttataatttcaggtggcatctttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaatagtggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagtaatggtaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctgcggttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 39 - protein, 550 aa, Artificial Sequence
  Synthetic Construct
MEDAKNIKKGPAPFYPLEDGTAGEQLHKAMKRYALVPGTIAFTDAHIEVNITYAEYFEMSVRLAEAMKRYGLNTNHRIVVCSENSLQFFMPVLGALFIGVAVAPANDIYNERELLNSMNISQPTVVFVSKKGLQKILNVQKKLPIIQKIIIMDSKTDYQGFQSMYTFVTSHLPPGFNEYDFVPESFDRDKTIALIMNSSGSTGLPKGVALPHRTACVRFSHARDPIFGNQIIPDTAILSVVPFHHGFGMFTTLGYLICGFRVVLMYRFEEELFLRSLQDYKIQSALLVPTLFSFFAKSTLIDKYDLSNLHEIASGGAPLSKEVGEAVAKRFHLPGIRQGYGLTETTSAILITPEGDDKPGAVGKVVPFFEAKVVDLDTGKTLGVNQRGELCVRGPMIMSGYVNNPEATNALIDKDGWLHSGDIAYWDEDEHFFIVDRLKSLIKYKGYQVAPAELESILLQHPNIFDAGVAGLPDDDAGELPAAVVVLEHGKTMTEKEIVDYVASQVTTAKKLRGGVVFVDEVPKGLTGKLDARKIREILIKAKKGGKSKL

SEQ ID NO: 40 - DNA, 7710 bp, Artificial Sequence
  AAV cis plasmid with AAV2-ITRs and firefly luciferase expression cassette and eGFP expression cassette
  CDS (1243)..(2895): firefly luciferase coding sequence
  CDS (3952)..(4671): eGFP coding sequence
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccagatttaattaaggctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagctagagtcgacaaagctagctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccaggcggccgccatggaagacgccaaaaacataaagaaaggcccggcgccattctatcctctagaggatggaaccgctggagagcaactgcataaggctatgaagagatacgccctggttcctggaacaattgcttttacagatgcacatatcgaggtgaacatcacgtacgcggaatacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgaacatttcgcagcctaccgtagtgtttgtttccaaaaaggggttgcaaaaaattttgaacgtgcaaaaaaaattaccaataatccagaaaattattatcatggattctaaaacggattaccagggatttcagtcgatgtacacgttcgtcacatctcatctacctcccggttttaatgaatacgattttgtaccagagtcctttgatcgtgacaaaacaattgcactgataatgaattcctctggatctactgggttacctaagggtgtggcccttccgcatagaactgcctgcgtcagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttttacgatcccttcaggattacaaaattcaaagtgcgttgctagtaccaaccctattttcattcttcgccaaaagcactctgattgacaaatacgatttatctaatttacacgaaattgcttctgggggcgcacctctttcgaaagaagtcggggaagcggttgcaaaacgcttccatcttccagggatacgacaaggatatgggctcactgagactacatcagctattctgattacacccgagggggatgataaaccgggcgcggtcggtaaagttgttccattttttgaagcgaaggttgtggatctggataccgggaaaacgctgggcgttaatcagagaggcgaattatgtgtcagaggacctatgattatgtccggttatgtaaacaatccggaagcgaccaacgccttgattgacaaggatggatggctacattctggagacatagcttactgggacgaagacgaacacttcttcatagttgaccgcttgaagtctttaattaaatacaaaggatatcaggtggcccccgctgaattggaatcgatattgttacaacaccccaacatcttcgacgcgggcgtggcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagtccaaattgtaataagcttggatccaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgagatctgcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggactcgacaaagctagcaatgtagtcttatgcaatactcttgcaacatgcttatgtaacgatgagttagcaacatgccttacaaggagagaaaaagcaccgtgcatgacgattggtggaagtaaggtggtacgatcgtgccttattaggaaggcaacagacgggtctgacatggattggacgaaccactgaattccgcattgcagagatattgtatttaagtgcctagctcgatacaataaacgccatttgaccattcaccacactgcagaaagcggccgccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaataagcttggatctttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaaaactcgagattctagagtcgagttaagggcgaattcccgattaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagccttaattaacctaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccccgatagacggtttttcgccctttgacgctggagttcacgttcctcaatagtggactcttgttccaaactggaacaacactcaaccctatctcggtctattcttttgatttataagggatttttccgatttcggcctattggttaaaaaatgagctgatttaacaaaaatttaacgcgaattttaacaaaatattaacgtttataatttcaggtggcatctttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaatagtggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagtaatggtaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctgcggttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 41 - protein, 550 aa, Artificial Sequence; identical to SEQ ID NO: 39
  Synthetic Construct

SEQ ID NO: 42 - protein, 239 aa, Artificial Sequence
  Synthetic Construct
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 43 - DNA, 9711 bp, Artificial Sequence
  AAV cis plasmid with AAV2-ITRs and firefly luciferase expression cassette and eGFP expression cassette and 2000-bp-ABCA4 stuffer
  CDS (3244)..(4896): firefly luciferase coding sequence
  CDS (5953)..(6672): eGFP coding sequence
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccagatttaattaaggctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagctagagtcgactcgacattctgattcaggacctctgtttgcgggtggcgctcagcagaaaagagaaaacgtcaacccccgacacccctgcttgggtcccagagagaaggctggacagacaccccaggactccaatgtctgctccccaggggcgccggctgctcacccagagggccagcctcccccagagccagagtgcccaggcccgcagctcaacacggggacacagctggtcctccagcatgtgcaggcgctgctggtcaagagattccaacacaccatccgcagccacaaggacttcctggcgcagatcgtgctcccggctacctttgtgtttttggctctgatgctttctattgttatccctccttttggcgaataccccgctttgacccttcacccctggatatatgggcagcagtacaccttcttcagcatggatgaaccaggcagtgagcagttcacggtacttgcagacgtcctcctgaataagccaggctttggcaaccgctgcctgaaggaagggtggcttccggagtacccctgtggcaactcaacaccctggaagactccttctgtgtccccaaacatcacccagctgttccagaagcagaaatggacacaggtcaacccttcaccatcctgcaggtgcagcaccagggagaagctcaccatgctgccagagtgccccgagggtgccgggggcctcccgcccccccagagaacacagcgcagcacggaaattctacaagacctgacggacaggaacatctccgacttcttggtaaaaacgtatcctgctcttataagaagcagcttaaagagcaaattctgggtcaatgaacagaggtatggaggaatttccattggaggaaagctcccagtcgtccccatcacgggggaagcacttgttgggtttttaagcgaccttggccggatcatgaatgtgagcgggggccctatcactagagaggcctctaaagaaatacctgatttccttaaacatctagaaactgaagacaacattaaggtgtggtttaataacaaaggctggcatgccctggtcagctttctcaatgtggcccacaacgccatcttacgggccagcctgcctaaggacaggagccccgaggagtatggaatcaccgtcattagccaacccctgaacctgaccaaggagcagctctcagagattacagtgctgaccacttcagtggatgctgtggttgccatctgcgtgattttctccatgtccttcgtcccagccagctttgtcctttatttgatccaggagcgggtgaacaaatccaagcacctccagtttatcagtggagtgagccccaccacctactgggtgaccaacttcctctgggacatcatgaattattccgtgagtgctgggctggtggtgggcatcttcatcgggtttcagaagaaagcctacacttctccagaaaaccttcctgcccttgtggcactgctcctgctgtatggatgggcggtcattcccatgatgtacccagcatccttcctgtttgatgtccccagcacagcctatgtggctttatcttgtgctaatctgttcatcggcatcaacagcagtgctattaccttcatcttggaattatttgagaataaccggacgctgctcaggttcaacgccgtgctgaggaagctgctcattgtcttcccccacttctgcctgggccggggcctcattgaccttgcactgagccaggctgtgacagatgtctatgcccggtttggtgaggagcactctgcaaatccgttccactgggacctgattgggaagaacctgtttgccatggtggtggaaggggtggtgtacttcctcctgaccctgctggtccagcgccacttcttcctctcccaatggattgccgagcccactaaggagcccattgttgatgaagatgatgatgtggctgaagaaagacaaagaattattactggtggaaataaaactgacatcttaaggctacatgtgtcgacaaagctagctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccaggcggccgccatggaagacgccaaaaacataaagaaaggcccggcgccattctatcctctagaggatggaaccgctggagagcaactgcataaggctatgaagagatacgccctggttcctggaacaattgcttttacagatgcacatatcgaggtgaacatcacgtacgcggaatacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgaacatttcgcagcctaccgtagtgtttgtttccaaaaaggggttgcaaaaaattttgaacgtgcaaaaaaaattaccaataatccagaaaattattatcatggattctaaaacggattaccagggatttcagtcgatgtacacgttcgtcacatctcatctacctcccggttttaatgaatacgattttgtaccagagtcctttgatcgtgacaaaacaattgcactgataatgaattcctctggatctactgggttacctaagggtgtggcccttccgcatagaactgcctgcgtcagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttttacgatcccttcaggattacaaaattcaaagtgcgttgctagtaccaaccctattttcattcttcgccaaaagcactctgattgacaaatacgatttatctaatttacacgaaattgcttctgggggcgcacctctttcgaaagaagtcggggaagcggttgcaaaacgcttccatcttccagggatacgacaaggatatgggctcactgagactacatcagctattctgattacacccgagggggatgataaaccgggcgcggtcggtaaagttgttccattttttgaagcgaaggttgtggatctggataccgggaaaacgctgggcgttaatcagagaggcgaattatgtgtcagaggacctatgattatgtccggttatgtaaacaatccggaagcgaccaacgccttgattgacaaggatggatggctacattctggagacatagcttactgggacgaagacgaacacttcttcatagttgaccgcttgaagtctttaattaaatacaaaggatatcaggtggcccccgctgaattggaatcgatattgttacaacaccccaacatcttcgacgcgggcgtggcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagtccaaattgtaataagcttggatccaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgagatctgcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggactcgacaaagctagcaatgtagtcttatgcaatactcttgcaacatgcttatgtaacgatgagttagcaacatgccttacaaggagagaaaaagcaccgtgcatgacgattggtggaagtaaggtggtacgatcgtgccttattaggaaggcaacagacgggtctgacatggattggacgaaccactgaattccgcattgcagagatattgtatttaagtgcctagctcgatacaataaacgccatttgaccattcaccacactgcagaaagcggccgccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaataagcttggatctttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaaaactcgagattctagagtcgagttaagggcgaattcccgattaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagccttaattaacctaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccccgatagacggtttttcgccctttgacgctggagttcacgttcctcaatagtggactcttgttccaaactggaacaacactcaaccctatctcggtctattcttttgatttataagggatttttccgatttcggcctattggttaaaaaatgagctgatttaacaaaaatttaacgcgaattttaacaaaatattaacgtttataatttcaggtggcatctttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaatagtggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagtaatggtaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctgcggttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 44 - protein, 550 aa, Artificial Sequence; identical to SEQ ID NO: 39
  Synthetic Construct

SEQ ID NO: 45 - protein, 239 aa, Artificial Sequence; identical to SEQ ID NO: 42
  Synthetic Construct

SEQ ID NO: 46 - DNA, 34 bp, Artificial Sequence
  RSV promoter forward primer
  misc_feature (1)..(34): RSV promoter forward oligonucleotide
gacaaagctagcaatgtagtcttatgcaatactc

SEQ ID NO: 47 - DNA, 38 bp, Artificial Sequence
  SV40 pA signal reverse primer
  misc_feature (1)..(38): oligonucleotide; SV40 late pA signal reverse primer
ctacaaatgtggtaaaactcgagattctagagtcgaca

SEQ ID NO: 48 - DNA, 8741 bp, Artificial Sequence
  AAV cis plasmid harboring lacZ expression cassette flanked by AAV2-ITRs
  misc_feature (248)..(377): AAV2-ITR; 5'
  promoter (453)..(1567): MCK promoter
  CDS (1569)..(4643): beta-Galactosidase coding sequence
  misc_feature (4644)..(5745): WPRE repeat (two repeats)
  polyA_signal (5746)..(5960): Bovine Growth Hormone polyadenylation signal
  misc_feature (6048)..(6177): AAV2-ITR; 3'
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccagatttaattaaggctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagctagtaacggccgccagtgtgctggaattcaggacgcgtgcgagtctgcgcccgcgctctgaacggcgtcgctgcccagcccccttccccgggaggtgggagcggccacccagggccccgtggctgcccttgtaaggaggcgaggcccgaggacacccgagacgcccggttataattaaccaggacacgtggcgaacccccctccaacacctgcccccgaacccccccatacccagcgcctcgggtctcggcctttgcggcagaggagacagcaaagcgccctctaaaaataactcctttcccggcgaccgagaccctccctgtcccccgcacagcggaaatctcccagtggcaccgagggggcgagggttaagtgggggggagggtgaccaccgcctcccacccttgccctgagtttgaatctctccaactcagccagcctcagtttcccctccactcagtccctaggaggaaggggcgcccaagcgcgggtttctggggttagactgccctccattgcaattggtccttctcccggcctctgcttcctccagctcacagggtatctgctcctcctggagccacaccttggttccccgaggtgccgctgggactcgggtaggggtgagggcccagggggcacagggggagccgagggccacaggaagggctggtggctgaaggagactcaggggccaggggacggtggcttctacgtgcttgggacgttcccagccaccgtcccatgttcccggcggggggccagctgtccccaccgccagcccaactcagcacttggtcagggtatcagcttggtgggggggcgtgagcccagcccctggggcggctcagcccatacaaggccatggggctgggcgcaaagcatgcctgggttcagggtgggtatggtgcgggagcagggaggtgagaggctcagctgccctccagaactcctccctggggacaacccctcccagccaatagcacagcctaggtccccctatataaggccacggctgctggcccttcctttgggtcagtgtcacctccaggatacagacagccccccttcagatctcctgaattctgcagatatccatcacactggcggccgccatgaccatgattacggattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgctttgcctggtttccggcaccagaagcggtgccggaaagctggctggagtgcgatcttcctgaggccgatactgtcgtcgtcccctcaaactggcagatgcacggttacgatgcgcccatctacaccaacgtaacctatcccattacggtcaatccgccgtttgttcccacggagaatccgacgggttgttactcgctcacatttaatgttgatgaaagctggctacaggaaggccagacgcgaattatttttgatggcgttaactcggcgtttcatctgtggtgcaacgggcgctgggtcggttacggccaggacagtcgtttgccgtctgaatttgacctgagcgcatttttacgcgccggagaaaaccgcctcgcggtgatggtgctgcgttggagtgacggcagttatctggaagatcaggatatgtggcggatgagcggcattttccgtgacgtctcgttgctgcataaaccgactacacaaatcagcgatttccatgttgccactcgctttaatgatgatttcagccgcgctgtactggaggctgaagttcagatgtgcggcgagttgcgtgactacctacgggtaacagtttctttatggcagggtgaaacgcaggtcgccagcggcaccgcgcctttcggcggtgaaattatcgatgagcgtggtggttatgccgatcgcgtcacactacgtctgaacgtcgaaaacccgaaactgtggagcgccgaaatcccgaatctctatcgtgcggtggttgaactgcacaccgccgacggcacgctgattgaagcagaagcctgcgatgtcggtttccgcgaggtgcggattgaaaatggtctgctgctgctgaacggcaagccgttgctgattcgaggcgttaaccgtcacgagcatcatcctctgcatggtcaggtcatggatgagcagacgatggtgcaggatatcctgctgatgaagcagaacaactttaacgccgtgcgctgttcgcattatccgaaccatccgctgtggtacacgctgtgcgaccgctacggcctgtatgtggtggatgaagccaatattgaaacccacggcatggtgccaatgaatcgtctgaccgatgatccgcgctggctaccggcgatgagcgaacgcgtaacgcgaatggtgcagcgcgatcgtaatcacccgagtgtgatcatctggtcgctggggaatgaatcaggccacggcgctaatcacgacgcgctgtatcgctggatcaaatctgtcgatccttcccgcccggtgcagtatgaaggcggcggagccgacaccacggccaccgatattatttgcccgatgtacgcgcgcgtggatgaagaccagcccttcccggctgtgccgaaatggtccatcaaaaaatggctttcgctacctggagagacgcgcccgctgatcctttgcgaatacgcccacgcgatgggtaacagtcttggcggtttcgctaaatactggcaggcgtttcgtcagtatccccgtttacagggcggcttcgtctgggactgggtggatcagtcgctgattaaatatgatgaaaacggcaacccgtggtcggcttacggcggtgattttggcgatacgccgaacgatcgccagttctgtatgaacggtctggtctttgccgaccgcacgccgcatccagcgctgacggaagcaaaacaccagcagcagtttttccagttccgtttatccgggcaaaccatcgaagtgaccagcgaatacctgttccgtcatagcgataacgagctcctgcactggatggtggcgctggatggtaagccgctggcaagcggtgaagtgcctctggatgtcgctccacaaggtaaacagttgattgaactgcctgaactaccgcagccggagagcgccgggcaactctggctcacagtacgcgtagtgcaaccgaacgcgaccgcatggtcagaagccgggcacatcagcgcctggcagcagtggcgtctggcggaaaacctcagtgtgacgctccccgccgcgtcccacgccatcccgcatctgaccaccagcgaaatggatttttgcatcgagctgggtaataagcgttggcaatttaaccgccagtcaggctttctttcacagatgtggattggcgataaaaaacaactgctgacgccgctgcgcgatcagttcacccgtgcaccgctggataacgacattggcgtaagtgaagcgacccgcattgaccctaacgcctgggtcgaacgctggaaggcggcgggccattaccaggccgaagcagcgttgttgcagtgcacggcagatacacttgctgatgcggtgctgattacgaccgctcacgcgtggcagcatcaggggaaaaccttatttatcagccggaaaacctaccggattgatggtagtggtcaaatggcgattaccgttgatgttgaagtggcgagcgatacaccgcatccggcgcggattggcctgaactgccagctggcgcaggtagcagagcgggtaaactggctcggattagggccgcaagaaaactatcccgaccgccttactgccgcctgttttgaccgctgggatctgccattgtcagacatgtataccccgtacgtcttcccgagcgaaaacggtctgcgctgcgggacgcgcgaattgaattatggcccacaccagtggcgcggcgacttccagttcaacatcagccgctacagtcaacagcaactgatggaaaccagccatcgccatctgctgcacgcggaagaaggcacatggctgaatatcgacggtttccatatggggattggtggcgacgactcctggagcccgtcagtatcggcggaattccagctgagcgccggtcgctaccattaccagttggtctggtgtcaaaaataaggatccaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgagatccaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgagatctgcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggactcgagttaagggcgaattcccgattaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagccttaattaacctaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccccgatagacggtttttcgccctttgacgctggagttcacgttcctcaatagtggactcttgttccaaactggaacaacactcaaccctatctcggtctattcttttgatttataagggatttttccgatttcggcctattggttaaaaaatgagctgatttaacaaaaatttaacgcgaattttaacaaaatattaacgtttataatttcaggtggcatctttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaatagtggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagtaatggtaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctgcggttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 49 - protein, 1024 aa, Artificial Sequence
  Synthetic Construct
MTMITDSLAVVLQRRDWENPGVTQLNRLAAHPPFASWRNSEEARTDRPSQQLRSLNGEWRFAWFPAPEAVPESWLECDLPEADTVVVPSNWQMHGYDAPIYTNVTYPITVNPPFVPTENPTGCYSLTFNVDESWLQEGQTRIIFDGVNSAFHLWCNGRWVGYGQDSRLPSEFDLSAFLRAGENRLAVMVLRWSDGSYLEDQDMWRMSGIFRDVSLLHKPTTQISDFHVATRFNDDFSRAVLEAEVQMCGELRDYLRVTVSLWQGETQVASGTAPFGGEIIDERGGYADRVTLRLNVENPKLWSAEIPNLYRAVVELHTADGTLIEAEACDVGFREVRIENGLLLLNGKPLLIRGVNRHEHHPLHGQVMDEQTMVQDILLMKQNNFNAVRCSHYPNHPLWYTLCDRYGLYVVDEANIETHGMVPMNRLTDDPRWLPAMSERVTRMVQRDRNHPSVIIWSLGNESGHGANHDALYRWIKSVDPSRPVQYEGGGADTTATDIICPMYARVDEDQPFPAVPKWSIKKWLSLPGETRPLILCEYAHAMGNSLGGFAKYWQAFRQYPRLQGGFVWDWVDQSLIKYDENGNPWSAYGGDFGDTPNDRQFCMNGLVFADRTPHPALTEAKHQQQFFQFRLSGQTIEVTSEYLFRHSDNELLHWMVALDGKPLASGEVPLDVAPQGKQLIELPELPQPESAGQLWLTVRVVQPNATAWSEAGHISAWQQWRLAENLSVTLPAASHAIPHLTTSEMDFCIELGNKRWQFNRQSGFLSQMWIGDKKQLLTPLRDQFTRAPLDNDIGVSEATRIDPNAWVERWKAAGHYQAEAALLQCTADTLADAVLITTAHAWQHQGKTLFISRKTYRIDGSGQMAITVDVEVASDTPHPARIGLNCQLAQVAERVNWLGLGPQENYPDRLTAACFDRWDLPLSDMYTPYVFPSENGLRCGTRELNYGPHQWRGDFQFNISRYSQQQLMETSHRHLLHAEEGTWLNIDGFHMGIGGDDSWSPSVSAEFQLSAGRYHYQLVWCQK

SEQ ID NO: 50 - DNA, 22 bp, Artificial Sequence
  forward primer; oligonucleotide for quantitative PCR; SV40 late pA
  misc_feature (1)..(22): forward primer; oligonucleotide for quantitative PCR; SV40 late pA
ccacaactagaatgcagtgaaa

SEQ ID NO: 51 - DNA, 22 bp, Artificial Sequence
  reverse primer; oligonucleotide for quantitative PCR; SV40 late pA
  misc_feature (1)..(22): reverse primer; oligonucleotide for quantitative PCR; SV40 late pA
cccctgaacctgaaacataaaa

SEQ ID NO: 52 - DNA, 23 bp, Artificial Sequence
  oligonucleotide for quantitative PCR
  misc_feature (1)..(23): oligonucleotide for quantiative PCR; BGH pA
  misc_feature (1)..(23): oligonucleotide for quantiative PCR; BGH pA; forward primer
cttctagttgccagccatctgtt

SEQ ID NO: 53 - DNA, 25 bp, Artificial Sequence
  reverse primer; oligonucleotide; quantitative PCR; BGH pA
  misc_feature (1)..(25): reverse primer; oligonucleotide for quantitative PCR; BGH pA
agaatgacacctactcagacaatgc

SEQ ID NO: 54 - DNA, 31 bp, Artificial Sequence
  forward primer; oligonucleotide; ABCA4/NotI+
  misc_feature (1)..(31): forward primer; oligonucleotide; ABCA4/NotI+
gcggccgccatgggcttcgtgagacagatac

SEQ ID NO: 55 - DNA, 34 bp, Artificial Sequence
  reverse primer; oligonucleotide; ABCA4/KpnI-
  misc_feature (1)..(34): reverse primer; oligonucleotide; ABCA4/KpnI-
cacctgatcaaggtaccaagcgagtaagccatag

SEQ ID NO: 56 - DNA, 33 bp, Artificial Sequence
  forward primer; oligonucleotide; ABCA4/XbaI+
  misc_feature (1)..(33): forward primer; oligonucleotide; ABCA4/XbaI+
cctgatttccttaaacatctagaaactgaagac

SEQ ID NO: 57 - DNA, 30 bp, Artificial Sequence
  reverse primer; oligonucleotide; ABCA4/HindIII-
  misc_feature (1)..(30): reverse primer; oligonucleotide; ABCA4/HindIII-
aagcttatcagtcctgggcttgtcgactgg

SEQ ID NO: 58 - DNA, 2562 bp, Homo sapiens
  CDS (1)..(2562): PDE6b coding sequence (homo sapiens)
atgagcctcagtgaggagcaggcccggagctttctggaccagaaccccgattttgcccgccagtactttgggaagaaactgagccctgagaatgtggccgcggcctgcgaggacgggtgcccgccggactgcgacagcctccgggacctctgccaggtggaggagagcacggcgctgctggagctggtgcaggatatgcaggagagcatcaacatggagcgcgtggtcttcaaggtcctgcggcgcctctgcaccctcctgcaggccgaccgctgcagcctcttcatgtaccgccagcgcaacggcgtggccgagctggccaccaggcttttcagcgtgcagccggacagcgtcctggaggactgcctggtgccccccgactccgagatcgtcttcccactggacatcggggtcgtgggccacgtggctcagaccaaaaagatggtgaacgtcgaggacgtggccgagtgccctcacttcagctcatttgctgacgagctcactgactacaagacaaagaatatgctggccacacccatcatgaatggcaaagacgtcgtggcggtgatcatggcagtgaacaagctcaacggcccattcttcaccagcgaagacgaagatgtgttcttgaagtacctgaattttgccacgttgtacctgaagatctatcacctgagctacctccacaactgcgagacgcgccgcggccaggtgctgctgtggtcggccaacaaggtgtttgaggagctgacggacatcgagaggcagttccacaaggccttctacacggtgcgggcctacctcaactgcgagcggtactccgtgggcctcctggacatgaccaaggagaaggaattttttgacgtgtggtctgtgctgatgggagagtcccagccgtactcgggcccacgcacgcctgatggccgggaaattgtcttctacaaagtgatcgactacatcctccacggcaaggaggagatcaaggtcattcccacaccctcagccgatcactgggccctggccagcggccttccaagctacgtggcagaaagcggctttatttgtaacatcatgaatgcttccgctgacgaaatgttcaaatttcaggaaggggccctggacgactccgggtggctcatcaagaatgtgctgtccatgcccatcgtcaacaagaaggaggagattgtgggagtcgccacattttacaacaggaaagacgggaagccctttgacgaacaggacgaggttctcatggagtccctgacacagttcctgggctggtcagtgatgaacaccgacacctacgacaagatgaacaagctggagaaccgcaaggacatcgcacaggacatggtcctttaccacgtgaagtgcgacagggacgagatccagctcatcctgccaaccagagcgcgcctggggaaggagcctgctgactgcgatgaggacgagctgggcgaaatcctgaaggaggagctgccagggcccaccacatttgacatctacgaattccacttctctgacctggagtgcaccgaactggacctggtcaaatgtggcatccagatgtactacgagctgggcgtggtccgaaagttccagatcccccaggaggtcctggtgcggttcctgttctccatcagcaaagggtaccggagaatcacctaccacaactggcgccacggcttcaacgtggcccagacgatgttcacgctgctcatgaccggcaaactgaagagctactacacggacctggaggccttcgccatggtgacagccggcctgtgccatgacatcgaccaccgcggcaccaacaacctgtaccagatgaagtcccagaaccccttggctaagctccacggctcctcgattttggagcggcaccacctggagtttgggaagttcctgctctcggaggagaccctgaacatctaccagaacctgaaccggcggcagcacgatcacgtgatccacctgatggacatcgccatcatcgccacggacctggccctgtacttcaagaagagagcgatgtttcagaagatcgtggatgagtccaagaactaccaggacaagaagagctgggtggagtacctgtccctggagacgacccggaaggagatcgtcatggccatgatgatgacagcctgcgacctgtctgccatcaccaagccctgggaagtccagagcaaggtcgcacttctcgtggctgctgagttctgggagcaaggtgacttggaaaggacagtcttggatcagcagcccattcctatgatggaccggaacaaggcggccgagctccccaagctgcaagtgggcttcatcgacttcgtgtgcacattcgtgtacaaggagttctctcgtttccacgaagagatcctgcccatgttcgaccgactgcagaacaataggaaagagtggaaggcgctggctgatgagtatgaggccaaagtgaaggctctggaggagaaggaggaggaggagagggtggcagccaagaaaggcacagaaatttgcaatggcggcccagcacccaagtcttcaacctgctgtatcctgtga

SEQ ID NO: 59 - protein, 853 aa, Homo sapiens
MSLSEEQARSFLDQNPDFARQYFGKKLSPENVAAACEDGCPPDCDSLRDLCQVEESTALLELVQDMQESINMERVVFKVLRRLCTLLQADRCSLFMYRQRNGVAELATRLFSVQPDSVLEDCLVPPDSEIVFPLDIGVVGHVAQTKKMVNVEDVAECPHFSSFADELTDYKTKNMLATPIMNGKDVVAVIMAVNKLNGPFFTSEDEDVFLKYLNFATLYLKIYHLSYLHNCETRRGQVLLWSANKVFEELTDIERQFHKAFYTVRAYLNCERYSVGLLDMTKEKEFFDVWSVLMGESQPYSGPRTPDGREIVFYKVIDYILHGKEEIKVIPTPSADHWALASGLPSYVAESGFICNIMNASADEMFKFQEGALDDSGWLIKNVLSMPIVNKKEEIVGVATFYNRKDGKPFDEQDEVLMESLTQFLGWSVMNTDTYDKMNKLENRKDIAQDMVLYHVKCDRDEIQLILPTRARLGKEPADCDEDELGEILKEELPGPTTFDIYEFHFSDLECTELDLVKCGIQMYYELGVVRKFQIPQEVLVRFLFSISKGYRRITYHNWRHGFNVAQTMFTLLMTGKLKSYYTDLEAFAMVTAGLCHDIDHRGTNNLYQMKSQNPLAKLHGSSILERHHLEFGKFLLSEETLNIYQNLNRRQHDHVIHLMDIAIIATDLALYFKKRAMFQKIVDESKNYQDKKSWVEYLSLETTRKEIVMAMMMTACDLSAITKPWEVQSKVALLVAAEFWEQGDLERTVLDQQPIPMMDRNKAAELPKLQVGFIDFVCTFVYKEFSRFHEEILPMFDRLQNNRKEWKALADEYEAKVKALEEKEEEERVAAKKGTEICNGGPAPKSSTCCIL

SEQ ID NO: 60 - DNA, 743 bp, Artificial Sequence
  RPE65 promoter (homo sapiens)
  promoter (1)..(743): RPE65 promoter (homo sapiens)
gctagctgagctcctctgggcagggctgtttctttccatctttgtattcccaggggcctgcaaataaatgtttaatgaacgaacaagagagtgaattccaattccatgcaacaaggattgggctcctgggccctaggctatgtgtctggcaccagaaacggaagctgcaggttgcagcccctgccctcatggagctcctcctgtcagaggagtgtggggactggatgactccagaggtaacttgtgggggaacgaacaggtaaggggctgtgtgacgagatgagagactgggagaataaaccagaaagtctctagctgtccagaggacatagcacagaggcccatggtccctatttcaaacccaggccaccagactgagctgggaccttgggacagacaagtcatgcagaagttaggggaccttctcctcccttttcctggatggatcctgagtaccttctcctccctgacctcaggcttcctcctagtgtcaccttggcccctcttagaagccaattaggccctcagtttctgcagcggggattaatatgattatgaacacccccaatctcccagatgctgattcagccaggagcttaggagggggaggtcactttataagggtctgggggggtcagaacccagagtcatccagctggagccctgagtggctgagctcaggccttcgcagcattcttgggtgggagcagccacgggtcagccacaagggccacagcggccgc

SEQ ID NO: 61 - DNA, 743 bp, Artificial sequence; identical to SEQ ID NO: 60
  Rhodopsin promoter
  promoter (1)..(743): Rhodopsin promoter (homo sapiens)

SEQ ID NO: 62 - DNA, 3 bp, Artificial Sequence
  oligonucleotide; forward primer; CMV promoter
aaa

SEQ ID NO: 63 - DNA, 1116 bp, Homo sapiens
  promoter (1)..(1116): MCK promoter
actagtaacggccgccagtgtgctggaattcaggacgcgtgcgagtctgcgcccgcgctctgaacggcgtcgctgcccagcccccttccccgggaggtgggagcggccacccagggccccgtggctgcccttgtaaggaggcgaggcccgaggacacccgagacgcccggttataattaaccaggacacgtggcgaacccccctccaacacctgcccccgaacccccccatacccagcgcctcgggtctcggcctttgcggcagaggagacagcaaagcgccctctaaaaataactcctttcccggcgaccgagaccctccctgtcccccgcacagcggaaatctcccagtggcaccgagggggcgagggttaagtgggggggagggtgaccaccgcctcccacccttgccctgagtttgaatctctccaactcagccagcctcagtttcccctccactcagtccctaggaggaaggggcgcccaagcgcgggtttctggggttagactgccctccattgcaattggtccttctcccggcctctgcttcctccagctcacagggtatctgctcctcctggagccacaccttggttccccgaggtgccgctgggactcgggtaggggtgagggcccagggggcacagggggagccgagggccacaggaagggctggtggctgaaggagactcaggggccaggggacggtggcttctacgtgcttgggacgttcccagccaccgtcccatgttcccggcggggggccagctgtccccaccgccagcccaactcagcacttggtcagggtatcagcttggtgggggggcgtgagcccagcccctggggcggctcagcccatacaaggccatggggctgggcgcaaagcatgcctgggttcagggtgggtatggtgcgggagcagggaggtgagaggctcagctgccctccagaactcctccctggggacaacccctcccagccaatagcacagcctaggtccccctatataaggccacggctgctggcccttcctttgggtcagtgtcacctccaggatacagacagccccccttcagatctcctgaattctgcagatatccatcacactggcggccgc

SEQ ID NO: 64 - DNA, 45 bp, Artificial Sequence
  forward primer; oligonucleotide; Clone/RSV+
tttctagagtcgacaaagctagcaatgtagtcttatgcaatactc

SEQ ID NO: 65 - DNA, 41 bp, Artificial Sequence
  oligonucleotide; reverse primer; Clone/RSV-
aagcggccgctttctgcagtgtggtgaatggtcaaatggcg

SEQ ID NO: 66 - DNA, 32 bp, Artificial Sequence
  oligonucleotide; forward primer; Clone/SV40+
ttagatctcagacatgataagatacattgatg

SEQ ID NO: 67 - DNA, 50 bp, Artificial Sequence
  oligonucleotide; reverse primer; Clone/SV40-
caagtaaaacctctacaaatgtggtaaaactcgagattctagagtcgaca

SEQ ID NO: 68 - DNA, 4496 bp, Artificial Sequence
  AAV cis plasmid harboring eGFP expression cassette under the control of the RSV promoter and the SV40 polyadenylation signal; the eGFP expression cassette is flanked by AAV2-ITRs
  misc_feature (248)..(377): AAV2-5'-ITR
  promoter (457)..(736): RSV promoter
  CDS (738)..(1457): eGFP coding sequence
  polyA_signal (1471)..(1701): SV40 late polyadenylation signal
  misc_feature (1803)..(1932): AAV2-3'-ITR
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccagatttaattaaggctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgtagccatgctctaggaagatcggaattcgcccttaagctagagtcgacaaagctagcaatgtagtcttatgcaatactcttgcaacatgcttatgtaacgatgagttagcaacatgccttacaaggagagaaaaagcaccgtgcatgacgattggtggaagtaaggtggtacgatcgtgccttattaggaaggcaacagacgggtctgacatggattggacgaaccactgaattccgcattgcagagatattgtatttaagtgcctagctcgatacaataaacgccatttgaccattcaccacactgcagaaagcggccgccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaataagcttggatctttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaaaactcgagattctagagtcgagttaagggcgaattcccgattaggatcttcctagagcatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagccttaattaacctaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccccgatagacggtttttcgccctttgacgctggagttcacgttcctcaatagtggactcttgttccaaactggaacaacactcaaccctatctcggtctattcttttgatttataagggatttttccgatttcggcctattggttaaaaaatgagctgatttaacaaaaatttaacgcgaattttaacaaaatattaacgtttataatttcaggtggcatctttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaatagtggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagtaatggtaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctgcggttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 69 - protein, 239 aa, Artificial Sequence; identical to SEQ ID NO: 42
  Synthetic Construct

What is claimed is:

1. An adeno-associated virus comprising an AAV capsid wherein the AAV capsid is selected from the group consisting of AAV serotype 5 and 7, and further comprising a recombinant AAV genome, where the size of the recombinant AAV genome is between 5.7 kb and 8 kb and where packaging of the recombinant AAV genome takes place inside a cell.

2. A DNAse I-resistant adeno-associated virus comprising an AAV capsid wherein the AAV capsid is selected from the group consisting of AAV serotype 5 and 7, and further comprising a recombinant AAV genome, where the size of the recombinant AAV genome is between 5.7 kb and 8 kb.

3. A DNAse I-resistant adeno-associated virus comprising an AAV capsid wherein the AAV capsid is selected from the group consisting of AAV serotype 1, AAV serotype 8 and BAAV, and further comprising a recombinant AAV genome, where the size of the recombinant AAV genome is between 5.7 kb and 6.9 kb.

4. A DNAse I-resistant adeno-associated virus comprising a recombinant AAV genome, where the size of the recombinant AAV genome is between 5.7 kb and 6.9 kb.

5. An adeno-associated virus comprising an AAV capsid wherein the AAV capsid is selected from the group consisting of AAV serotype 1, AAV serotype 8 and BAAV, and further comprising a recombinant AAV genome, where the size of the recombinant AAV genome is between 5.7 kb and 6.9 kb and where packaging of the recombinant AAV genome takes place inside a cell.

6. A DNAse I-resistant adeno-associated virus comprising an AAV capsid wherein the AAV capsid is selected from the group consisting of AAV serotype 2 or AAV serotype 4, where the size of the recombinant AAV genome is between 5.7 kb and 6.9 kb.

7. The adeno-associated virus of claim 2, 1, 3 or 5, wherein said adeno-associated virus is produced by means of an AAV cis plasmid, where said AAV cis plasmid enables the production of a self-complementary AAV vector.

8. The adeno-associated virus of claim 2, 1, 3 or 5, wherein said adeno-associated virus is produced by means of an AAV cis plasmid, where said AAV cis plasmid comprises a transgene expression cassette, where said transgene expression cassette is flanked on one site by an ITR of AAV serotype 2 and on the other site by an ITR of AAV serotype 5.

9. The adeno-associated virus of claim 2, 1, 3 or 5, wherein said recombinant AAV genome comprises the Clotting Factor VIII coding sequence.

10. The adeno-associated virus of claim 2, 1, 3 or 5, wherein said recombinant AAV genome comprises a B-deleted Clotting Factor VIII coding sequence.

11. A method of introducing the recombinant AAV genome of claim 2, 1, 3 or 5 into a mammalian cell by bringing said mammalian cell into physical contact with an adeno-associated virus harboring said genome.

12. A method of introducing the recombinant AAV genome of claim 2 or 3 into a mammalian cell in vitro.

13. A method of introducing the recombinant AAV genome of claim 1 or 5 into a mammalian cell in vivo.

14. A method of expressing Factor VIII in a mammalian cell comprising: Providing the AAV vector of claim 2, 1, 3 or 5, which vector further comprises a heterologous sequence encoding Factor VIII, operably linked to a promoter, and wherein the expression of said heterologous sequence leads to the expression and secretion of Factor VIII;
and bringing the AAV vector into physical contact with a mammalian cell, whereby said mammalian cell is transduced by the AAV vector, resulting in the expression and secretion of Factor VIII.

15. A method of expressing B-deleted Factor VIII in a mammalian cell comprising: Providing the AAV vector of claim 2, 1, 3 or 5, which vector further comprises a heterologous sequence encoding B-deleted Factor VIII, operably linked to a promoter, and wherein the expression of said heterologous sequence leads to the expression and secretion of B-deleted Factor VIII; and bringing the AAV vector into physical contact with a mammalian cell, whereby said mammalian cell is transduced by the AAV vector, resulting in the expression and secretion of B-deleted Factor VIII.

16. A method of expressing Factor VIII in a mammalian subject comprising: Providing the AAV vector of claim 2, 1, 3 or 5, which vector further comprises a heterologous sequence encoding Factor VIII, operably linked to a promoter, and wherein the expression of said heterologous sequence leads to the expression and secretion of Factor VIII;

and administering in vivo the AAV vector to the mammalian subject, whereby cells are transduced by the AAV vector, resulting in the expression and secretion of Factor VIII.

17. A method of expressing B-deleted Factor VIII in a mammalian subject comprising: Providing the AAV vector of claim 2, 1, 3 or 5, which vector further comprises a heterologous sequence encoding B-deleted Factor VIII, operably linked to a promoter, and wherein the expression of said heterologous sequence leads to the expression and secretion of B-deleted Factor VIII; and administering in vivo the AAV vector to the mammalian subject, whereby cells are transduced by the AAV vector, resulting in the expression and secretion of B-deleted Factor VIII.

18. The adeno-associated virus of claims 2 or 1, wherein the adeno-associated virus capsid is of AAV serotype 5.

19. The adeno-associated virus of claim 2 or 1, wherein the adeno-associated virus capsid is of AAV serotype 7.

20. A method for producing the adeno-associated virus of claim 2, 1, 3 or 5, where each producer cell produces at least 500 AAV virions.

21. A method for producing the adeno-associated virus of claim 2, 1, 3 or 5, where each producer cell produces at least 1,000 AAV virions.

22. A method for producing the adeno-associated virus of claim 2, 1, 3 or 5, where each producer cell produces at least 2,000 AAV virions.

23. A method for producing the adeno-associated virus of claim 2, 1, 3 or 5, where each producer cell produces at least 4,000 AAV virions.

24. A method for producing the adeno-associated virus of claim 2, 1, 3 or 5, where $1.25 \times 10^8$ AAV virions are produced by adherent producer cells per $cm^2$ of growth area.

25. A method for producing the adeno-associated virus of claim 2, 1, 3 or 5, where $2 \times 10^8$ AAV virions are produced by adherent producer cells per $cm^2$ of growth area.

26. A method for producing the adeno-associated virus of claim 2, 1, 3 or 5, where $5 \times 10^8$ AAV virions are produced by adherent producer cells per $cm^2$ of growth area.

27. A method for producing the adeno-associated virus of claim 2, 1, 3 or 5, where $10^9$ AAV virions are produced by adherent producer cells per $cm^2$ of growth area.

* * * * *